US011913036B2

(12) United States Patent
Borra-Garske et al.

(10) Patent No.: US 11,913,036 B2
(45) Date of Patent: Feb. 27, 2024

(54) ENGINEERED ACETATE KINASE VARIANT ENZYMES

(71) Applicant: Codexis, Inc., Redwood City, CA (US)

(72) Inventors: Margie Tabuga Borra-Garske, Palo Alto, CA (US); Oscar Alvizo, Fremont, CA (US); Lillian Jasmine Miller, Saratoga, CA (US); Aksiniya Lyubenova Petkova, Sunnyvale, CA (US)

(73) Assignee: Codexis, Inc., Redwood City, CA (US)

( * ) Notice: Subject to any disclaimer, the term of this patent is extended or adjusted under 35 U.S.C. 154(b) by 0 days.

(21) Appl. No.: 17/711,451

(22) Filed: Apr. 1, 2022

(65) Prior Publication Data

US 2022/0325256 A1 Oct. 13, 2022

Related U.S. Application Data

(60) Provisional application No. 63/170,017, filed on Apr. 2, 2021.

(51) Int. Cl.
C12N 9/12 (2006.01)

(52) U.S. Cl.
CPC .... *C12N 9/1217* (2013.01); *C12Y 207/02001* (2013.01)

(58) Field of Classification Search
None
See application file for complete search history.

(56) References Cited

U.S. PATENT DOCUMENTS

| | | |
|---|---|---|
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,928,905 A | 7/1999 | Stemmer et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin et al. |
| 6,265,201 B1 | 7/2001 | Wackett et al. |
| 6,277,638 B1 | 8/2001 | Stemmer |
| 6,287,861 B1 | 9/2001 | Stemmer et al. |
| 6,287,862 B1 | 9/2001 | delCardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | delCardayre et al. |
| 6,335,160 B1 | 1/2002 | Patten et al. |
| 6,335,198 B1 | 1/2002 | delCardayre et al. |
| 6,337,186 B1 | 1/2002 | Krebber |
| 6,344,356 B1 | 2/2002 | Stemmer |
| 6,352,859 B1 | 3/2002 | delCardayre et al. |
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |

(Continued)

FOREIGN PATENT DOCUMENTS

| | | |
|---|---|---|
| WO | 95/22625 A1 | 8/1995 |
| WO | 95/33836 A1 | 12/1995 |

(Continued)

OTHER PUBLICATIONS

Chica et al. Curr Opin Biotechnol. Aug. 2005;16(4):378-84. (Year: 2005).*
Singh et al. Curr Protein Pept Sci. 2017, 18, 1-11 (Year: 2017).*
Accession Q9WYB1. Nov. 1, 1999 (Year: 1999).*
Accession G4FHI8. Dec. 14, 2011 (Year: 2011).*
Bornscheuer et al. Curr Protoc Protein Sci. Nov. 2011;Chapter 26:Unit26.7 (Year: 2011).*
Yoshikuni et al. Curr Opin Chem Biol. Apr. 2007;11(2):233-9 (Year: 2007).*
Smith, T., et al., "Comparison of Biosequences," Adv. Appl. Math, 2:482-489 (1981).
Stemmer, W., "DNA Shuffling by Random Fragmentation and Reassembly: In vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).

(Continued)

*Primary Examiner* — Christian L Fronda
(74) *Attorney, Agent, or Firm* — Codexis, Inc.

(57) ABSTRACT

The present invention provides engineered acetate kinase (AcK) enzymes, polypeptides having AcK activity, and polynucleotides encoding these enzymes, as well as vectors and host cells comprising these polynucleotides and polypeptides. Methods for producing AcK enzymes are also provided. The present invention further provides compositions comprising the AcK enzymes and methods of using the engineered AcK enzymes. The present invention finds particular use in the production of pharmaceutical compounds.

17 Claims, No Drawings

Specification includes a Sequence Listing.

(56) References Cited

U.S. PATENT DOCUMENTS

| | | |
|---|---|---|
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,605,430 B1 | 8/2003 | Affholter et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selifonov et al. |
| 6,946,296 B2 | 9/2005 | Patten et al. |
| 6,961,664 B2 | 11/2005 | Selifonov et al. |
| 6,995,017 B1 | 2/2006 | Stemmer |
| 7,024,312 B1 | 4/2006 | Selifonov et al. |
| 7,058,515 B1 | 6/2006 | Selifonov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,462,469 B2 | 6/2008 | Raillard et al. |
| 7,421,347 B2 | 9/2008 | Selifonov et al. |
| 7,430,477 B2 | 9/2008 | Selifonov et al. |
| 7,534,564 B2 | 5/2009 | Patten et al. |
| 7,620,500 B2 | 11/2009 | Mundorff et al. |
| 7,620,502 B2 | 11/2009 | Selifonov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selifonov et al. |
| 7,868,138 B2 | 1/2011 | Stemmer et al. |
| 7,873,477 B1 | 1/2011 | Gustafsson et al. |
| 7,873,499 B2 | 1/2011 | Selifonov et al. |
| 7,904,249 B2 | 3/2011 | Selifonov et al. |
| 7,957,912 B2 | 6/2011 | Selifonov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Minshull et al. |
| 8,076,138 B2 | 12/2011 | delCardayre et al. |
| 8,108,150 B2 | 1/2012 | Mundorff et al. |
| 8,170,806 B2 | 5/2012 | Selifonov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selifonov et al. |
| 8,762,066 B2 | 6/2014 | Fox |
| 8,768,871 B2 | 7/2014 | Fox |
| 9,593,326 B2 | 3/2017 | Clark et al. |
| 9,665,694 B2 | 5/2017 | Cope |
| 9,684,771 B2 | 6/2017 | Cope et al. |
| 9,714,437 B2 | 7/2017 | Chan et al. |
| 2008/0220990 A1 | 9/2008 | Fox |
| 2009/0312196 A1 | 12/2009 | Colbeck et al. |

FOREIGN PATENT DOCUMENTS

| | | |
|---|---|---|
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 2000/42651 A1 | 7/2000 |
| WO | 2001/75767 A2 | 10/2001 |
| WO | 2009/008908 A2 | 1/2009 |
| WO | 2009/152336 A1 | 12/2009 |
| WO | 2020/014041 A1 | 1/2020 |
| WO | 2021/003129 A2 | 1/2021 |

OTHER PUBLICATIONS

Stenico, M., et al., "Codon usage in Caenorhabditis elegans: delineation of translational selection and mutational biases," Nucl. Acids Res. 22(13): 2437-46 [1994].

Suggs, S.V., et al., "Use of synthetic oligodeoxyribonucleotides for the isolation of specific cloned DNA sequenes," In Developmental Biology Using Purified Genes (Brown et al., eds.), pp. 683-693, Academic Press (1981).

Takahashi, T., et al., "Efficient gene disruption in the koji-mold *Aspergillus sojae* using a novel variation of the positive-negative method," Mol. Gen. Genom., 272: 344-352 [2004].

Tiwari, S., et al., "Prediction of probable genes by Fourier analysis of genomic sequences," Comput. Appl. Biosci. 13(3):263-270 [1997].

Truppo, M.D., et al., "Development of an Improved Immobilized CAL-B for the Enzymatic Resolution of a Key Intermediate to Odanacatib," Organic Process Research & Development, 15:1033-1035 (2011).

Uberbacher, E.C., et al., "Discovering and Understanding Genes in Human DNA Sequence Using GRAIL," Methods Enzymol., 266:259-281 [1996].

Villa-Komaroff, L., et al., "A bacterial clone synthesizing proinsulin," Proc. Natl Acad. Sci. USA, 75:3727-3731 (1978).

Wada, K., et al., "Codon usage tabulated from the GenBank genetic sequence data," Nucl. Acids Res., 20:2111-2118 [1992].

Wells, J.A., et al., "Cassette mutagenesis: an efficient method for generation of multiple mutations at defined sites," Gene, 34:315-323 (1985).

Wetmur, J. G., "DNA Probes: Applications of the Principles of Nucleic Acid Hybridization," Crit Rev Biochem Mol Biol, 26(3/4):227-259 (1991).

Wilson, I.A., et al., "The structure of antigenic determinant in a protein," Cell, 37:767-778 [1984].

Wright, F., "The 'effective number of codons' used in a gene," Gene 87:23-29 [1990].

Yi, S., et al., "Covalent immobilization of omega-transaminase from Vibrio fluvialis JS17 on chitosan beads," Process Biochemistry 42(5): 895-898 (2007).

You, B., et al., "Gene-specifc disruption in the filamentous fungus *Cercospora nicotianae* using a split-marker approach," Arch Microbiol., 191:615-622 [2009].

Zhang, J-H., et al., "Directed evolution of a fucosidase from a galactosidase by DNA shuffling and screening," Proc. Nat. Acad. Sci., U.S.A., 94:4504-4509 (1997).

UniProt Accession No. A0A1H3DL57 dated Nov. 22, 2017.

PDB ID: 2IIR. Mukhopadhyay, S., Hasson, M.S., Sanders, D.A. [2007] Acetate kinase from a hypothermophile Thermotoga maritima. DOI: 10.2210/pdb2IIR/pdb.

Studer, R.A., et al., "Residue mutations and their impact on protein structure and function: detecting beneficial and pathogenic changes," 449:581-597 [2013].

(56) References Cited

OTHER PUBLICATIONS

Altschul, S., et al., "Basic local alignment search tool," J. Mol. Biol., 215: 403-410 (1990).
Altschul, S.F., et al., "Gapped BLAST and PSI-BLAST: a new generation of protein database search programs," Nucleic Acids Res., 25(17):3389-3402 (1997).
Baldino, Jr., F., et al., "High-Resolution in Situ Hybridization Histochemistry," Methods Enzymology, 168:761-777 (1989).
Batzer, M.A., "Erratum: Structure and variability of recently inserted Alu family members", Nucleic Acids Res 19:698-699 [1991].
Bolton, E.T., et al., "A General Method for the Iisolation of RNA Complementary to DNA," Proc. Natl. Acad. Sci. USA 48:1390 (1962).
Botstein, D., et al., "Strategies and applications of in vitro mutagenesis," Science, 229(4719):1193-1201 [1985].
Breslauer, K.J., et al., "Predicting DNA duplex stability from the base sequence," Proc. Natl. Acad. Sci. USA, 83:3746-3750 (1986).
Carter, P., "Site-directed mutagenesis," Biochem. J., 237:1-7 (1986).
Chaveroche, M., et al., "A rapid method for efficient gene replacement in the filamentous fungus *Aspergillus nidulans*," Nucl. Acids Res., 28:22 e97 [2000].
Cho, Y., et al., "A high throughput targeted gene disruption method for *Alternaria brassicicola* functional genomics using linear minimal element (LME) constructs," Mol Plant Microbe Interact, 19(1):7-15 [2006].
Christians, F.C., et al., "Directed evolution of thymidine kinase for AZT phosphorylation using DNA family shuffling," Nat. Biotechnol., 17:259-264 (1999).
Combier, J.-P., et al., "Agrobacterium tumefaciens-mediated transformation as a tool for insertional mutagenesis in the symbiotic ectomycorrhizal fungus *Hebeloma cylindrosporum*," FEMS Microbiol Lett., 220:141-8 [2003].
Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling," Nat. Biotechnol., 14(3):315-319 (1996).
Crameri, A., et al., "Molecular evolution of an arsenate detoxification pathway by DNA shuffling," Nat. Biotechnol., 15(5):436-438 (1997).
Dale, S.J., et al., "Oligonucleotide-directed random mutagenesis using the phosphorothioate method," Methods Mol. Biol., 57:369-74 (1996).
De Boer, H.A., et al., "The tac promoter: A functional hybrid derived from the trp and lac promoters," Proc. Natl Acad. Sci. USA, 80: 21-25 (1983).
Ehrlich, S.D., "DNA cloning in Bacillus subtilis," Proc Natl Acad Sci. USA, 75:1433 (1978).
Eisenberg, D., et al., "Analysis of Membrane and Surface Protein Sequences with the Hydrophobic Moment Plot," J. Mol. Biol., 179:125-142 [1984].
Fasman, G.D., CRC Practical Handbook of Biochemistry and Molecular Biology, CRC Press, Boca Raton, FL, pp. 3-70 [1989].
Firon, A., et al., "Identification of Essential Genes in the Human Fungal Pathogen *Aspergillus fumigatus* by Transposon Mutagenesis," Eukaryot. Cell, 2(2):247-55 [2003].
Freier, S.M., et al., "Improved free-energy parameters for predictions of RNA duplex stability," Proc. Natl. Acad. Sci USA, 83:9373-9377 (1986).
Gao, P., et al., "Cyclic [G(2',5')pA(3',5')p] Is the Metazoan Second Messenger Produced by DNA-Activated Cyclic GMP-AMP Synthase," Cell. 153(5): 1094-1107 [2013].
Guo, Z., et al., "3'-End-Forming Signals of Yeast mRNA," Mol. Cell. Biol., 15(11):5983-5990 [1995].

Henaut and Danchin in Neidhardt et al. [eds.], *Escherichia coli* and *Salmonella*, "Analysis and predictions from *Escherichia coli* Sequences, or *E. coli* in silico," ASM Press, Washington D.C., [1987], pp. 2047-2066.
Henikoff, S.,et al., "Amino acid substitution matrices from protein blocks," Proc. Natl. Acad. Sci., 89:10915-10919 (1992).
Hong, J., et al., "Cloning and functional expression of thermostable beta-glucosidase gene from Thermoascus aurantiacus," Appl. Microbiol. Biotechnol, 73:1331-1339 [2007].
Kierzek, R., et al., "Polymer-Supported RNA Synthesis and Its Application To Test the Nearest-Neighbor Model for Duplex Stability," Biochemistry, 25:7840-7846 (1986).
Koszelewski, D., et al., "Immobilization of omega-transaminases by encapsulation in a sol-gel/celite matrix," Journal of Molecular Catalysis B: Enzymatic, 63: 39-44 (2010).
Kramer, B., et al., "Different base/base mismatches are corrected with different efficiencies by the methyl-directed DNA mismatch-repair system of *E. coli*," Cell, 38(3):879-887 [1984].
Kranzusch, P.J., et al., "Structure of Human Cgas Reveals a Conserved Family of Second-Messenger Enzymes in Innate Immunity," Cell Rep., 3(5): 1362-1368 [2013].
Lathe, R., et al., "Plasmid and bacteriophage vectors for excision of intact inserts," Gene, 57:193-201 (1987).
Li, T., et al., "Antitumor Activity of cGAMP via Stimulation of cGAS-cGAMPSTING—IRF3 Mediated Innate Immune Response," Sci. Rep., 6:19049 [2016].
Ling, M., et al., "Approaches to DNA Mutagenesis:An Overview," Anal. Biochem., 254:157-78 (1997).
Martin, A.R., et al., "Characterization of free and immobilized (S)-aminotransferase for acetophenone production," Applied Microbiology and Biotechnology, 76(4): 843-851 (2007).
Maruyama, J., "Multiple gene disruptions by marker recycling with highly efficient gene-targeting background (delta-igD) in *Aspergillus oryzae*," Biotechnol Lett., 30:1811-1817 [2008].
Mateo, C., et al., "Epoxy sepabeads: a novel epoxy support for stabilization of industrial enzymes via very intense multipoint covalent attachment," Biotechnology Progress 18(3):629-34 (2002).
Mcinerney, J.O., "GCUA: general codon usage analysis," Bioinformatics, 14(4):372-73, 1998.
Mcintosh, J.A., et al., "A kinase-cGAS cascade to synthesize atherapeutic STING activator," Nature, 603:439-447 [2022].
Minshull, J., et al., "Protein evolution by molecular breeding," Curr. Op. Chem. Biol., 3(3):284-290 (1999).
Nakamura, Y., et al., "Codon usage tabulated from international DNA sequence databases: status for the year 2000," Nucl. Acids Res., 28:292 [2000].
Needleman, S., et al., "A general method applicable to the search for similarities in the amino acid sequence of two proteins," J. Mol. Biol. 48:443-453 (1970).
Parry, N.J., et al., "Biochemical characterization and mechanism of action of a thermostablebeta-glucosidase purified from Thermoascus aurantiacus," Biochem. J., 353:117-127 [2001].
Pearson, W.R., "Improved tools for biological sequence comparison," Proc. Nat'l. Acad. Sci. USA, 85:2444-2448 (1988).
Porath, J., "Immobilized metal ion affinity chromatography," Protein Expression and Purification, 3:263-281 (1992).
Romanos, M.A., et al., "Foreign gene expression in yeast: a review," Yeast 8:423-488 [1992].
Rychlik, W., et al., "Optimization of the annealing temperature for DNA amplification in vitro," Nucleic Acids Res, 18(21):6409-6412 (1990).
Schönheit, P., et al., "Metabolism of hyperthermophiles," World J Microbiol Biotechnol., 11(1):26-57 [1995].
Simonen, M., et al., "Protein Secretion in *Bacillus* Species," Microbiological Reviews, 57:109-137 (1993).
Smith, M., "In vitro mutagenesis," Ann. Rev. Genet., 19:423-462 (1985).

\* cited by examiner

US 11,913,036 B2

ENGINEERED ACETATE KINASE VARIANT ENZYMES

The present application claims priority to U.S. Prov. Pat. Appln. Ser. No. 63/170,017, filed Apr. 2, 2021, which is incorporated by reference in its entirety, for all purposes.

FIELD OF THE INVENTION

The present invention provides engineered acetate kinase (AcK) enzymes, polypeptides having AcK activity, and polynucleotides encoding these enzymes, as well as vectors and host cells comprising these polynucleotides and polypeptides. Methods for producing AcK enzymes are also provided. The present invention further provides compositions comprising the AcK enzymes and methods of using the engineered AcK enzymes. The present invention finds particular use in the production of pharmaceutical compounds.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX2-205US1_ST25.txt", a creation date of Mar. 31, 2022, and a size of 1.35 megabytes. The Sequence Listing filed via EFS-Web is part of the specification and incorporated in its entirety by reference herein.

BACKGROUND OF THE INVENTION

The STING pathway, which regulates the body's immune response to foreign DNA, has emerged as an important target for cancer therapies. In particular, cyclic dinucleotides that are known to activate STING are attractive targets to activate or enhance the innate immune response. Cyclic dinucleotides may be generated enzymatically by cyclization of nucleoside triphosphate substrates. cGAMP, a cyclic dinucleotide, is known to function as a second messenger that stimulates innate immunity through the endoplasmic reticulum sensor STING. cGAMP activation of STING was demonstrated to have an anti-tumor effect in mice through induction of production of interferon and stimulation of dendritic cells (Li et al., Sci. Rep. 6:19049 [2016]) cGAMP is produced in response to double-stranded DNA (dsDNA) by cyclic GMP-AMP synthase (cGAS) (Gao et al., Cell. 153:1094-1107 [2013]), which functions as a cellular sensor of foreign nucleic acids. cGAS activity requires binding of dsDNA, with single-stranded DNA (ssDNA) or RNA ligands producing only weak or no activity, respectively. Binding to dsDNA causes conformational changes in cGAS to induce the active enzyme state (Kranzusch et al., Cell Rep. 3(5): 1362-1368 [2013]).

Several cGAS crystal structures have been generated, including murine and human cGAS. These crystal structures reveal several conserved domains, including a nucleotidyltransferase core, a zinc finger domain, and a C-terminal domain (Gao et al., Cell. 153(5): 1094-1107 [2013]; Kranzusch et al., Cell Rep. 3(5): 1362-1368 [2013]). In addition to bound dsDNA, cGAS requires a divalent metal cation (typically $Mn^{2+}$ or $Mg^{2+}$) for activity. cGAS synthesizes cGAMP from adenosine triphosphate (ATP) and guanosine triphosphate (GTP). In turn, these substrates are produced by adenylate kinase (AdK) and guanylate kinase (GK), respectively, which require acetate kinase (AcK) for both the final phosphorylation step and to recycle nucleoside diphosphates to the nucleoside triphosphates consumed by the reaction.

There is a need for improved cancer therapies utilizing cyclic dinucleotides and non-natural cyclic dinucleotides to stimulate immunity Specifically, improved methods of generating cyclic dinucleotides and non-natural cyclic dinucleotides using industrial process conditions are necessary. One approach is to utilize engineered polypeptides with improved properties to produce nucleoside triphosphate substrates and non-natural cyclic dinucleotides.

SUMMARY OF THE INVENTION

The present invention provides engineered acetate kinase (AcK) enzymes, polypeptides having AcK activity, and polynucleotides encoding these enzymes, as well as vectors and host cells comprising these polynucleotides and polypeptides. Methods for producing AcK enzymes are also provided. The present invention further provides compositions comprising the AcK enzymes and methods of using the engineered AcK enzymes. The present invention finds particular use in the production of pharmaceutical compounds.

The present invention provides engineered acetate kinases comprising polypeptide sequences having at least 85%, 86%, 87%, 88%, 89%, 90%, 91%, 92%, 93%, 94%, 95%, 96%, 97%, 98%, 99%, or more sequence identity to SEQ ID NO: 2 and/or 4, or a functional fragment thereof, wherein said engineered acetate kinase comprises a polypeptide comprising at least one substitution or substitution set in said polypeptide sequence, and wherein the amino acid positions of said polypeptide sequence are numbered with reference to SEQ ID NO: 2 and/or 4. In some embodiments, the polypeptide sequence has at least 85%, 86%, 87%, 88%, 89%, 90%, 91%, 92%, 93%, 94%, 95%, 96%, 97%, 98%, 99%, or more sequence identity to SEQ ID NO: 2, and wherein the polypeptide of the engineered acetate kinase comprises at least one substitution or substitution set at one or more positions in said polypeptide sequence selected from 4/142/242, 12/76/164/284, 12/76/232, 15, 23, 39, 41, 47, 51, 52, 54, 57, 76, 76/164/232/262/386, 76/164/262/284, 76/232/262/284/386, 76/232/364/386, 76/262, 76/262/273, 76/262/364, 76/273, 76/284/299, 76/364, 130, 135/284, 135/392, 145/400, 191, 232, 232/386, 275, 285, 288, 290, 292, 294, 297, 298, 298/377, 298/405, 343, 372, 373, 374, 376, 391, and 392, wherein the amino acid positions of said polypeptide sequence are numbered with reference to SEQ ID NO: 2. In some embodiments, the polypeptide sequence of the engineered acetate kinase has at least 85%, 86%, 87%, 88%, 89%, 90%, 91%, 92%, 93%, 94%, 95%, 96%, 97%, 98%, 99%, or more sequence identity to SEQ ID NO: 4, and wherein the polypeptide of the engineered acetate kinase comprises at least one substitution or substitution set at one or more positions in said polypeptide sequence selected from 4-/142V/242T, 12K/76V/164M/284L, 12K/76V/232S, 15N, 23H, 23N, 39A, 41F, 47A, 47S, 47W, 51F, 52W, 54V, 57R, 76V, 76V/164M/232S/262L/386K, 76V/164M/262L/284L, 76V/232S/262L/284L/386K, 76V/232S/364I/386K, 76V/262L, 76V/262L/273V, 76V/262L/364I, 76V/273V, 76V/284L/299D, 76V/364I, 130V, 135T/284T, 135T/392W, 145E/400V, 191I, 232S, 232S/386K, 275H, 275T, 285T, 288S, 288T, 290L, 292P, 294L, 297N, 298G, 298G/377Q, 298L, 298L/405E, 298S, 298T, 298V, 298W, 343C, 343S, 372C, 372L, 372N, 372R, 372V, 373P, 374A, 374D, 374H, 374L, 374M, 374P, 374Q, 374S, 374W, 376S, 376V, 391G, and 392W, wherein the amino acid positions of said polypeptide sequence are numbered with reference to SEQ ID NO: 2. In some embodiments, the polypeptide sequence of the engineered acetate kinase has at least 85%, 86%, 87%, 88%, 89%, 90%, 91%, 92%, 93%, 94%, 95%, 96%, 97%, 98%, 99%, or more sequence identity to SEQ ID NO: 2, and wherein the polypeptide of the engineered acetate kinase comprises at least one substitution or substitution set at one or more positions in said polypeptide sequence selected from H4-/A142V/L242T, R12K/I76V/I164M/Y284L, R12K/I76V/C232S, V15N, I23H, I23N, G39A, A41F, E47A, E47S, E47W, L51F, V52W, R54V, D57R, I76V, I76V/I164M/C232S/I262L/R386K, I76V/I164M/I262L/Y284L, I76V/C232S/I262L/Y284L/R386K, I76V/C232S/L364I/R386K, I76V/I262L, I76V/I262L/M273V, I76V/I262L/L364I, I76V/M273V, I76V/Y284L/E299D, I76V/L364I, P130V, A135T/Y284T, A135T/V392W, K145E/I400V, T191I, C232S, C232S/R386K, D275H, D275T, G285T, K288S, K288T, F290L, S292P, M294L, I297N, E298G, E298G/E377Q, E298L, E298L/K405E, E298S, E298T, E298V, E298W, G343C, G343S, T372C, T372L, T372N, T372R, T372V, I373P, R374A, R374D, R374H, R374L, R374M, R374P, R374Q, R374S, R374W, K376S, K376V, V391G, and V392W, wherein the amino acid positions of said polypeptide sequence are numbered with reference to SEQ ID NO: 2. In some embodiments, the engineered acetate kinase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2. In some embodiments, the engineered acetate kinase comprises a polypeptide sequence having at least 90%, 91%, 92%, 93%, 94%, 95%, 96%, 97%, 98%, 99%, or more sequence identity to SEQ ID NO: 2. In some embodiments, the engineered acetate kinase comprises a polypeptide sequence having at least 95%, 96%, 97%, 98%, 99%, or more sequence identity to SEQ ID NO: 2.

In some embodiments, the polypeptide sequence has at least 85%, 86%, 87%, 88%, 89%, 90%, 91%, 92%, 93%, 94%, 95%, 96%, 97%, 98%, 99%, or more sequence identity to SEQ ID NO: 2, and wherein the polypeptide of the engineered acetate kinase comprises at least one substitution or substitution set at one or more positions in said polypeptide sequence selected from 4/142/242, 12/76/164, 15, 23, 39, 41, 44, 45, 47, 47/411, 48, 50, 51, 53, 55, 57/135, 58, 58/135, 61, 76, 76/142/299/386, 76/164, 76/164/232/262/386, 76/164/262, 76/164/273, 76/164/287/364, 76/164/386, 76/232, 76/232/259/364, 76/232/262, 76/232/273/299/311/386, 76/232/364/386, 76/262, 76/262/273, 76/262/284/287/386, 76/262/284/364, 76/262/287, 76/262/364, 76/273, 76/284/299, 76/284/311/386, 76/364, 76/386, 130, 132, 135/284, 135/392, 145/400, 164/232/284/287, 191, 220, 220/360, 241, 246, 262/284/287, 273/311/313/364, 275, 279, 283, 285, 287, 288, 289, 290, 292, 294, 297, 298, 298/405, 299, 311, 311/364/386, 332, 340, 343, 343/388, 347, 364, 372, 373, 374, 375, 376, 391, 392, and 405, wherein the amino acid positions of said polypeptide sequence are numbered with reference to SEQ ID NO: 2. In some embodiments, the polypeptide sequence of the engineered acetate kinase has at least 85%, 86%, 87%, 88%, 89%, 90%, 91%, 92%, 93%, 94%, 95%, 96%, 97%, 98%, 99%, or more sequence identity to SEQ ID NO: 2, and wherein the polypeptide of the engineered acetate kinase comprises at least one substitution or substitution set at one or more positions in said polypeptide sequence selected from 4-/142V/242T, 12K/76V/164M, 15A, 15N, 15S, 23H, 23N, 39A, 39S, 39T, 41F, 44V, 45L, 45W, 47I, 47M, 47N, 47P, 47R, 47S, 47S/411F, 48R, 50Q, 51F, 53I, 55S, 57S/135T, 58N/135T, 58S/135T, 58W, 61S, 61T, 76V, 76V/142V/299D/386K, 76V/164M, 76V/164M/232S/262L/386K, 76V/164M/262L, 76V/164M/273V, 76V/164M/287T/364I, 76V/164M/386K, 76V/232S, 76V/232S/259V/364I, 76V/232S/262L, 76V/232S/273V/299D/311A/386K, 76V/232S/364I/386K, 76V/262L, 76V/262L/273V, 76V/262L/284L/287T/386K, 76V/262L/284L/364I, 76V/262L/287T, 76V/262L/364I, 76V/273V, 76V/284L/299D, 76V/284L/311A/386K, 76V/364I, 76V/386K, 130V, 132G, 135T/284T, 135T/392W, 145E/400V, 164M/232S/284L/287T, 191I, 191V, 220G, 220S/360V, 241T, 246Q, 246Y, 262L/284L/287T, 273V/311A/313D/364I, 275F, 275H, 275S, 275T, 275Y, 279R, 283M, 285S, 285T, 287G, 287L, 287N, 287T, 288H, 288R, 289S, 290H, 290I, 290L, 290R, 290V, 292P, 292R, 294F, 294L, 297N, 298L, 298L/405E, 299Q, 299V, 299W, 311A, 311A/364I/386K, 332D, 340G, 343E, 343T, 343T/388I, 347I, 347Q, 347S, 364I, 372D, 372G, 372L, 372N, 372R, 372V, 373P, 373S, 374A, 374D, 374P, 374S, 374W, 375P, 376S, 391G, 392P, and 405E, wherein the amino acid positions of said polypeptide sequence are numbered with reference to SEQ ID NO: 2. In some embodiments, the polypeptide sequence of the engineered acetate kinase has at least 85%, 86%, 87%, 88%, 89%, 90%, 91%, 92%, 93%, 94%, 95%, 96%, 97%, 98%, 99%, or more sequence identity to SEQ ID NO: 2, and wherein the polypeptide of the engineered acetate kinase comprises at least one substitution or substitution set at one or more positions in said polypeptide sequence selected from H4-/A142V/L242T, R12K/I76V/I164M, VISA, V15N, V15S, I23H, I23N, G39A, G39S, G39T, A41F, I44V, G45L, G45W, E47I, E47M, E47N, E47P, E47R, E47S, E47S/I411F, G48R, R50Q, L51F, H53I, V55S, D57S/A135T, E58N/A135T, E58S/A135T, E58W, V61S, V61T, I76V, I76V/A142V/E299D/R386K, I76V/I164M, I76V/I164M/C232S/I262L/R386K, I76V/I164M/I262L, I76V/I164M/M273V, I76V/I164M/S287T/L364I, I76V/I164M/R386K, I76V/C232S, I76V/C232S/P259V/L364I, I76V/C232S/I262L, I76V/C232S/M273V/E299D/V311A/R386K, I76V/C232S/L364I/386K, I76V/I262L, I76V/I262L/M273V, I76V/I262L/Y284L/S287T/R386K, I76V/I262L/Y284L/L364I, I76V/I262L/S287T, I76V/I262L/L364I, I76V/M273V, I76V/Y284L/E299D, I76V/Y284L/V311A/R386K, I76V/L364I, I76V/R386K, P130V, H132G, A135T/Y284T, A135T/V392W, K145E/I400V, I164M/C232S/Y284L/S287T, T191I, T191V, N220G, N220S/L360V, P241T, V246Q, V246Y, I262L/Y284L/S287T, M273V/V311A/E313D/L364I, D275F, D275H, D275S, D275T, D275Y, K279R, V283M, G285S, G285T, S287G, S287L, S287N, S287T, K288H, K288R, G289S, F290H, F290I, F290L, F290R, F290V, S292P, S292R, M294F, M294L, I297N, E298L, E298L/K405E, E299Q, E299V, E299W, V311A, V311A/L364I/R386K, G332D, A340G, G343E, G343T, G343T/K388I, P347I, P347Q, P347S, L364I, T372D, T372G, T372L, T372N, T372R, T372V, I373P, I373S, R374A, R374D, R374P, R374S, R374W, G375P, K376S, V391G, V392P, and K405E, wherein the amino acid positions of said polypeptide sequence are numbered with reference to SEQ ID NO: 2. In some embodiments, the engineered acetate kinase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2. In some embodiments, the engineered acetate kinase comprises a polypeptide sequence having at least 90%, 91%, 92%, 93%, 94%, 95%, 96%, 97%, 98%, 99%, or more sequence identity to SEQ ID NO: 2. In some embodiments, the engineered acetate kinase comprises a polypeptide sequence having at least 95%, 96%, 97%, 98%, 99%, or more sequence identity to SEQ ID NO: 2.

In some embodiments, the polypeptide sequence has at least 85%, 86%, 87%, 88%, 89%, 90%, 91%, 92%, 93%, 94%, 95%, 96%, 97%, 98%, 99%, or more sequence identity to SEQ ID NO: 4, and wherein the polypeptide of the engineered acetate kinase comprises at least one substitution or substitution set at one or more positions in said polypeptide sequence selected from 14, 14/46, 14/46/47, 14/46/75/ 293/296/342, 14/46/284/342/371, 14/46/293, 14/50/231/ 283/296, 14/75, 14/284/371, 14/310/391, 14/373, 22/46/ 296/373, 22/75/342, 22/231/283/373, 22/283/293/296, 22/296, 22/296/373, 22/372/373, 38/283/296/373, 38/296/ 373, 40/289/372/373, 46, 46/47/284/293, 46/47/284/390/ 391, 46/47/284/391, 46/50/54/342/373, 46/50/75/373, 46/50/283/296/297/373, 46/50/293/296, 46/50/293/297, 46/284/371, 46/293, 46/371/390/391, 47/75/284/293/371, 47/284/371/391, 47/293/310/371, 47/342/391, 50/75/283/ 293/296, 50/75/296, 50/75/373, 50/231/283/342, 50/231/ 373, 50/268/289/372/373, 50/283/293/296, 50/283/293/342/ 373, 50/289/372/373, 50/293/296, 50/372, 75/284/391, 75/293/296/373, 75/293/342, 75/293/391, 75/342/371, 231/ 283/342, 231/293/296/373, 231/296/342, 231/342/373, 283/ 293/296, 283/293/296/342, 283/296, 283/296/297/342, 283/ 296/342/373, 283/296/373, 283/356, 284/293/310/342/371, 284/293/390, 284/293/390/391, 284/342/371, 284/342/390, 284/390, 289, 289/372/373, 293, 293/296, 293/296/297, 293/296/342/373, 293/296/373, 293/342/373, 293/371, 293/ 390, 296/297, 296/342, 310/342/391, 310/371/391, 342, 342/371/391, 371, 371/390, 372/373, 373, and 390/391, wherein the amino acid positions of said polypeptide sequence are numbered with reference to SEQ ID NO: 4. In some embodiments, the polypeptide sequence of the engineered acetate kinase has at least 85%, 86%, 87%, 88%, 89%, 90%, 91%, 92%, 93%, 94%, 95%, 96%, 97%, 98%, 99%, or more sequence identity to SEQ ID NO: 4, and wherein the polypeptide of the engineered acetate kinase comprises at least one substitution or substitution set at one or more positions in said polypeptide sequence selected from 14N, 14N/46A, 14N/46A/75V/293L/296V/342C, 14N/ 46A/293L, 14N/46S/47R, 14N/50F/231S/283L/296S, 14N/ 75V, 14N/284T/371D, 14N/373D, 14S/46S/284S/342T/ 371G, 14S/310A/391P, 22H/46A/296V/373D, 22H/75V/ 342C, 22H/231S/283L/373D, 22H/283L/293L/296S, 22H/ 296S/373D, 22H/296V, 22N/372P/373A, 38A/283L/296V/ 373D, 38A/296V/373D, 40F/289R/372P/373P, 46A/50F/ 54A/342C/373D, 46A/50F/75V/373D, 46A/50F/283L/ 296V/297G/373D, 46A/50F/293L/296V, 46A/50F/293L/ 297G, 46A/293L, 46R/47R/284S/390G/391P, 46R/371D/ 390G/391P, 46S, 46S/47R/284S/293L, 46S/47R/284S/391P, 46S/284S/371D, 47R/75V/284S/293L/371G, 47R/284S/ 371G/391P, 47R/293L/310A/371D, 47R/342T/391P, 50F/ 75V/283L/293L/296T, 50F/75V/296V, 50F/75V/373D, 50F/ 231S/283L/342C, 50F/231S/373D, 50F/268G/289R/372S/ 373A, 50F/283L/293L/296V, 50F/283L/293L/342C/373D, 50F/289R/372P/373A, 50F/289V/372P/373A, 50F/293L/ 296V, 50F/372P, 75V/284S/391P, 75V/293L/296V/373D, 75V/293L/342C, 75V/293L/391P, 75V/342T/371D, 75V/ 342T/371G, 231S/283L/342C, 231S/293L/296V/373D, 231S/296V/342C, 231S/342C/373D, 283L/293L/296V, 283L/293L/296V/342C, 283L/296S/342C/373D, 283L/ 296V, 283L/296V/297G/342C, 283L/296V/373D, 283L/ 356P, 284S/293L/310A/342T/371G, 284S/293L/390G/ 391P, 284S/342T/371D, 284S/390G, 284T/293L/390G, 284T/342T/371D, 284T/342T/390G, 289R/372P/373P, 289V, 289V/372S/373A, 293L, 293L/296S/373D, 293L/ 296V, 293L/296V/297G, 293L/296V/342C/373D, 293L/ 296V/373D, 293L/342C/373D, 293L/371D, 293L/390G, 296V/297G, 296V/342C, 310A/342T/391P, 310A/371G/ 391P, 342C, 342T/371D/391P, 371G, 371G/390G, 372S/ 373A, 372S/373P, 373D, and 390G/391P, wherein the amino acid positions of said polypeptide sequence are numbered with reference to SEQ ID NO: 4. In some embodiments, the polypeptide sequence of the engineered acetate kinase has at least 85%, 86%, 87%, 88%, 89%, 90%, 91%, 92%, 93%, 94%, 95%, 96%, 97%, 98%, 99%, or more sequence identity to SEQ ID NO: 4, and wherein the polypeptide of the engineered acetate kinase comprises at least one substitution or substitution set at one or more positions in said polypeptide sequence selected from V14N, V14N/E46A, V14N/ E46A/I75V/M293L/I296V/G342C, V14N/E46A/M293L, V14N/E46S/G47R, V14N/L50F/C231S/Y283L/I296S, V14N/I75V, V14N/G284T/T371D, V14N/R373D, V14S/ E46S/G284S/G342T/T371G, V14S/V310A/V391P, I22H/ E46A/I296V/R373D, I22H/I75V/G342C, I22H/C231S/ Y283L/R373D, I22H/Y283L/M293L/I296S, I22H/I296S/ R373D, I22H/I296V, I22N/I372P/R373A, G38A/Y283L/ I296V/R373D, G38A/I296V/R373D, A40F/F289R/I372P/ R373P, E46A/L50F/V54A/G342C/R373D, E46A/L50F/ I75V/R373D, E46A/L50F/Y283L/I296V/E297G/R373D, E46A/L50F/M293L/I296V, E46A/L50F/M293L/E297G, E46A/M293L, E46R/G47R/G284S/V390G/V391P, E46R/ T371D/V390G/V391P, E46S, E46S/G47R/G284S/M293L, E46S/G47R/G284S/V391P, E46S/G284S/T371D, G47R/ I75V/G284S/M293L/T371G, G47R/G284S/T371G/V391P, G47R/M293L/V310A/T371D, G47R/G342T/V391P, L50F/ I75V/Y283L/M293L/I296T, L50F/I75V/I296V, L50F/I75V/ R373D, L50F/C231S/Y283L/G342C, L50F/C231S/R373D, L50F/S268G/F289R/I372S/R373A, L50F/Y283L/M293L/ I296V, L50F/Y283L/M293L/G342C/R373D, L50F/F289R/ I372P/R373A, L50F/F289V/I372P/R373A, L50F/M293L/ I296V, L50F/I372P, I75V/G284S/V391P, I75V/M293L/ I296V/R373D, I75V/M293L/G342C, I75V/M293L/V391P, I75V/G342T/T371D, I75V/G342T/T371G, C231S/Y283L/ G342C, C231S/M293L/I296V/R373D, C231S/I296V/ G342C, C231S/G342C/R373D, Y283L/M293L/I296V, Y283L/M293L/I296V/G342C, Y283L/I296S/G342C/ R373D, Y283L/I296V, Y283L/I296V/E297G/G342C, Y283L/I296V/R373D, Y283L/L356P, G284S/M293L/ V310A/G342T/T371G, G284S/M293L/V390G/V391P, G284S/G342T/T371D, G284S/V390G, G284T/M293L/ V390G, G284T/G342T/T371D, G284T/G342T/V390G, F289R/I372P/R373P, F289V, F289V/I372S/R373A, M293L, M293L/I296S/R373D, M293L/I296V, M293L/ I296V/E297G, M293L/I296V/G342C/R373D, M293L/ I296V/R373D, M293L/G342C/R373D, M293L/T371D, M293L/V390G, I296V/E297G, I296V/G342C, V310A/ G342T/V391P, V310A/T371G/V391P, G342C, G342T/ T371D/V391P, T371G, T371G/V390G, I372S/R373A, I372S/R373P, R373D, and V390G/V391P, wherein the amino acid positions of said polypeptide sequence are numbered with reference to SEQ ID NO: 4. In some embodiments, the engineered acetate kinase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 4. In some embodiments, the engineered acetate kinase comprises a polypeptide sequence having at least 90%, 91%, 92%, 93%, 94%, 95%, 96%, 97%, 98%, 99%, or more sequence identity to SEQ ID NO: 4. In some embodiments, the engineered acetate kinase comprises a polypeptide sequence having at least 95%, 96%, 97%, 98%, 99%, or more sequence identity to SEQ ID NO: 4.

In some embodiments, the polypeptide sequence has at least 85%, 86%, 87%, 88%, 89%, 90%, 91%, 92%, 93%, 94%, 95%, 96%, 97%, 98%, 99%, or more sequence identity to SEQ ID NO: 4, and wherein the polypeptide of the engineered acetate kinase comprises at least one substitution or substitution set at one or more positions in said polypeptide sequence selected from 14/38/50/75/293/296, 14/342/391, 38/46/50/75/373, 46/293, 47/342/391, 50/75/283/293/296, 50/75/296, 50/103/296/342, 50/231/373, 50/268/289/372/373, 50/283/293/296, 50/283/293/342/373, 50/293, 50/293/296, 50/372/373, 75/283/296, 75/293/296/297, 75/293/391, 75/342/371, 75/390/391, 283/296, 289, 289/372, 289/372/373, 293/342/373, 293/342/391, 293/371, 296, 296/342, 310/342/391, 342, 372, and 372/373, wherein the amino acid positions of said polypeptide sequence are numbered with reference to SEQ ID NO: 4. In some embodiments, the polypeptide sequence of the engineered acetate kinase has at least 85%, 86%, 87%, 88%, 89%, 90%, 91%, 92%, 93%, 94%, 95%, 96%, 97%, 98%, 99%, or more sequence identity to SEQ ID NO: 4, and wherein the polypeptide of the engineered acetate kinase comprises at least one substitution or substitution set at one or more positions in said polypeptide sequence selected from 14N/38A/50F/75V/293L/296S, 14N/342T/391P, 38A/46A/50F/75V/373D, 46A/293L, 47R/342T/391P, 50F/75V/283L/293L/296T, 50F/75V/296V, 50F/I03A/296T/342C, 50F/231S/373D, 50F/268G/289R/372S/373A, 50F/283L/293L/296V, 50F/283L/293L/342C/373D, 50F/293L, 50F/293L/296V, 50F/372S/373A, 75V/283L/296S, 75V/293L/296S/297G, 75V/293L/391P, 75V/342T/371D, 75V/390G/391P, 283L/296V, 289R/372P/373P, 289R/372S, 289V, 289V/372S/373A, 293L/342C/373D, 293L/342T/391P, 293L/371D, 296V, 296V/342C, 310A/342T/391P, 342C, 342T, 372P, and 372S/373A, wherein the amino acid positions of said polypeptide sequence are numbered with reference to SEQ ID NO: 4. In some embodiments, the polypeptide sequence of the engineered acetate kinase has at least 85%, 86%, 87%, 88%, 89%, 90%, 91%, 92%, 93%, 94%, 95%, 96%, 97%, 98%, 99%, or more sequence identity to SEQ ID NO: 4, and wherein the polypeptide of the engineered acetate kinase comprises at least one substitution or substitution set at one or more positions in said polypeptide sequence selected from V14N/G38A/L50F/I75V/M293L/I296S, V14N/G342T/V391P, G38A/E46A/L50F/I75V/R373D, E46A/M293L, G47R/G342T/V391P, L50F/I75V/Y283L/M293L/I296T, L50F/I75V/I296V, L50F/G103A/I296T/G342C, L50F/C231S/R373D, L50F/S268G/F289R/I372S/R373A, L50F/Y283L/M293L/I296V, L50F/Y283L/M293L/G342C/R373D, L50F/M293L, L50F/M293L/I296V, L50F/I372S/R373A, I75V/Y283L/I296S, I75V/M293L/I296S/E297G, I75V/M293L/V391P, I75V/G342T/T371D, I75V/V390G/V391P, Y283L/I296V, F289R/I372P/R373P, F289R/I372S, F289V, F289V/I372S/R373A, M293L/G342C/R373D, M293L/G342T/V391P, M293L/T371D, I296V, I296V/G342C, V310A/G342T/V391P, G342C, G342T, I372P, and I372S/R373A, wherein the amino acid positions of said polypeptide sequence are numbered with reference to SEQ ID NO: 4. In some embodiments, the engineered acetate kinase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 4. In some embodiments, the engineered acetate kinase comprises a polypeptide sequence having at least 90%, 91%, 92%, 93%, 94%, 95%, 96%, 97%, 98%, 99%, or more sequence identity to SEQ ID NO: 4. In some embodiments, the engineered acetate kinase comprises a polypeptide sequence having at least 95%, 96%, 97%, 98%, 99%, or more sequence identity to SEQ ID NO: 4.

In some additional embodiments, the present invention provides engineered acetate kinases, wherein the engineered acetate kinases comprise polypeptide sequences that are at least 85%, 86%, 87%, 88%, 89%, 90%, 91%, 92%, 93%, 94%, 95%, 96%, 97%, 98%, 99% or more identical to the sequence of at least one engineered acetate kinase variant set forth in Table 2-1, 3-1, 4-1, and/or 5-1.

In some additional embodiments, the present invention provides engineered acetate kinases, wherein the engineered acetate kinases comprise polypeptide sequences that are at least 85%, 86%, 87%, 88%, 89%, 90%, 91%, 92%, 93%, 94%, 95%, 96%, 97%, 98%, 99% or more identical to SEQ ID NO: 2 and/or 4. In some embodiments, the engineered acetate kinase comprises a variant engineered acetate kinase set forth in SEQ ID NO: 4.

The present invention also provides engineered acetate kinases wherein the engineered acetate kinases comprise polypeptide sequences that are at least 85%, 86%, 87%, 88%, 89%, 90%, 91%, 92%, 93%, 94%, 95%, 96%, 97%, 98%, 99% or more identical to the sequence of at least one engineered acetate kinase variant set forth in the even numbered sequences of SEQ ID NOS: 4-550.

The present invention further provides engineered acetate kinases, wherein said engineered acetate kinases comprise at least one improved property compared to a wild-type *Thermotoga maritima* acetate kinase. In some embodiments, the improved property comprises improved activity on a substrate. In some further embodiments, the substrate comprises of Sp-3'Fluoro-3'-deoxyguanosine-5'-(1-thio)-diphosphate (F-thioGDP or compound (7)) and/or Sp-2'F-ara-adenosine-5'-(1-thio)-diphosphate (F-thioADP or compound (5)). In some additional embodiments, the improved property comprises improved production of Sp-3'Fluoro-3'-deoxyguanosine-5'-(1-thio)-triphosphate (F-thioGTP or compound (2)) and/or Sp-2'F-ara-adenosine-5'-(1-thio)-triphosphate (F-thioATP or compound (3)). In yet some additional embodiments, the engineered acetate kinase is purified. The present invention also provides compositions comprising at least one engineered acetate kinase provided herein.

The present invention also provides polynucleotide sequences encoding at least one engineered acetate kinase provided herein. In some embodiments, the polynucleotide sequence encoding at least one engineered acetate kinase comprises a polynucleotide sequence having at least 85%, 86%, 87%, 88%, 89%, 90%, 91%, 92%, 93%, 94%, 95%, 96%, 97%, 98%, 99%, or more sequence identity to SEQ ID NOS: 1 and/or 3. In some embodiments, the polynucleotide sequence encoding at least one engineered acetate kinase, comprises a polynucleotide sequence having at least 85%, 86%, 87%, 88%, 89%, 90%, 91%, 92%, 93%, 94%, 95%, 96%, 97%, 98%, 99%, or more sequence identity to SEQ ID NOS: 1 and/or 3, wherein the polynucleotide sequence of said engineered acetate kinase comprises at least one substitution at one or more positions. In some further embodiments, the polynucleotide sequence encoding at least one engineered acetate kinase or a functional fragment thereof comprises at least 85%, 86%, 87%, 88%, 89%, 90%, 91%, 92%, 93%, 94%, 95%, 96%, 97%, 98%, 99%, or more sequence identity to SEQ ID NOS: 1 and/or 3. In yet some additional embodiments, the polynucleotide sequence is operably linked to a control sequence. In some further embodiments, the polynucleotide sequence is codon optimized. In still some additional embodiments, the polynucleotide sequence comprises a polynucleotide sequence set forth in the odd numbered sequences of SEQ ID NOS: 3-549.

The present invention also provides expression vectors comprising at least one polynucleotide sequence provided herein. The present invention further provides host cells comprising at least one expression vector provided herein.

In some embodiments, the present invention provides host cells comprising at least one polynucleotide sequence provided herein.

The present invention also provides methods of producing an engineered acetate kinase in a host cell, comprising culturing the host cell provided herein, under suitable conditions, such that at least one engineered acetate kinase is produced. In some embodiments, the methods further comprise recovering at least one engineered acetate kinase from the culture and/or host cell. In some additional embodiments, the methods further comprise the step of purifying said at least one engineered acetate kinase.

DESCRIPTION OF THE INVENTION

The present invention provides engineered acetate kinase (AcK) enzymes, polypeptides having AcK activity, and polynucleotides encoding these enzymes, as well as vectors and host cells comprising these polynucleotides and polypeptides. Methods for producing AcK enzymes are also provided. The present invention further provides compositions comprising the AcK enzymes and methods of using the engineered AcK enzymes. The present invention finds particular use in the production of pharmaceutical compounds.

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the invention as a whole.

It is to be understood that both the foregoing general description and the following detailed description are exemplary and explanatory only and are not restrictive of the present invention. The section headings used herein are for organizational purposes only and not to be construed as limiting the subject matter described. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

Abbreviations and Definitions

The abbreviations used for the genetically encoded amino acids are conventional and are as follows: alanine (Ala or A), arginine (Arg or R), asparagine (Asn or N), aspartate (Asp or D), cysteine (Cys or C), glutamate (Glu or E), glutamine (Gln or Q), histidine (His or H), isoleucine (Ile or I), leucine (Leu or L), lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V).

When the three-letter abbreviations are used, unless specifically preceded by an "L" or a "D" or clear from the context in which the abbreviation is used, the amino acid may be in either the L- or D-configuration about α-carbon (Cα). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleosides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

In reference to the present invention, the technical and scientific terms used in the descriptions herein will have the meanings commonly understood by one of ordinary skill in the art, unless specifically defined otherwise. Accordingly, the following terms are intended to have the following meanings.

As used herein, the singular forms "a", "an" and "the" include plural referents unless the context clearly indicates otherwise. Thus, for example, reference to "a polypeptide" includes more than one polypeptide.

Similarly, "comprise," "comprises," "comprising" "include," "includes," and "including" are interchangeable and not intended to be limiting. Thus, as used herein, the term "comprising" and its cognates are used in their inclusive sense (i.e., equivalent to the term "including" and its corresponding cognates).

It is to be further understood that where descriptions of various embodiments use the term "comprising," those skilled in the art would understand that in some specific instances, an embodiment can be alternatively described using language "consisting essentially of" or "consisting of."

As used herein, the term "about" means an acceptable error for a particular value. In some instances, "about" means within 0.05%, 0.5%, 1.0%, or 2.0%, of a given value range. In some instances, "about" means within 1, 2, 3, or 4 standard deviations of a given value.

As used herein, "EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

As used herein, "ATCC" refers to the American Type Culture Collection whose biorepository collection includes genes and strains.

As used herein, "NCBI" refers to National Center for Biological Information and the sequence databases provided therein.

As used herein, "acetate kinase ("AcK") enzymes (EC 2.7.2.1) are enzymes that are capable of catalyzing the phosphorylation of nucleoside diphosphates (or their analogues) to nucleoside triphosphates (or their analogues) using acetyl phosphate or another phosphoryl group donor. Acetate kinases include the engineered polypeptides of the current disclosure, which are capable of catalyzing the conversion of F-thioADP (5) and F-thioGDP (7) to F-thioATP (3) and F-thioGTP (2), respectively, using acetyl phosphate as the phosphate donor. Acetate kinases may be naturally occurring, wild-type enzymes or may be engineered enzymes, manipulated or synthesized through human intervention, as is known in the art. Acetate kinases may be or may be derived from naturally occurring, wild-type basic metabolic enzymes found primarily in prokaryotes that catalyze the phosphorylation of acetate to acetyl-CoA in the presence of ATP.

"Protein," "polypeptide," and "peptide" are used interchangeably herein to denote a polymer of at least two amino acids covalently linked by an amide bond, regardless of length or post-translational modification (e.g., glycosylation or phosphorylation). Included within this definition are D- and L-amino acids, and mixtures of D- and L-amino acids, as well as polymers comprising D- and L-amino acids, and mixtures of D- and L-amino acids.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, "hydrophilic amino acid or residue" refers to an amino acid or residue having a side chain exhibiting a hydrophobicity of less than zero according to the normalized consensus hydrophobicity scale of Eisenberg et al., (Eisenberg et al., J. Mol. Biol., 179:125-142 [1984]). Genetically encoded hydrophilic amino acids include L-Thr (T), L-Ser (S), L-His (H), L-Glu (E), L-Asn (N), L-Gln (Q), L-Asp (D), L-Lys (K) and L-Arg (R).

As used herein, "acidic amino acid or residue" refers to a hydrophilic amino acid or residue having a side chain exhibiting a pKa value of less than about 6 when the amino acid is included in a peptide or polypeptide. Acidic amino acids typically have negatively charged side chains at physiological pH due to loss of a hydrogen ion. Genetically encoded acidic amino acids include L-Glu (E) and L-Asp (D).

As used herein, "basic amino acid or residue" refers to a hydrophilic amino acid or residue having a side chain exhibiting a pKa value of greater than about 6 when the amino acid is included in a peptide or polypeptide. Basic amino acids typically have positively charged side chains at physiological pH due to association with hydronium ion. Genetically encoded basic amino acids include L-Arg (R) and L-Lys (K).

As used herein, "polar amino acid or residue" refers to a hydrophilic amino acid or residue having a side chain that is uncharged at physiological pH, but which has at least one bond in which the pair of electrons shared in common by two atoms is held more closely by one of the atoms. Genetically encoded polar amino acids include L-Asn (N), L-Gln (Q), L-Ser (S) and L-Thr (T).

As used herein, "hydrophobic amino acid or residue" refers to an amino acid or residue having a side chain exhibiting a hydrophobicity of greater than zero according to the normalized consensus hydrophobicity scale of Eisenberg et al., (Eisenberg et al., J. Mol. Biol., 179:125-142 [1984]). Genetically encoded hydrophobic amino acids include L-Pro (P), L-Ile (I), L-Phe (F), L-Val (V), L-Leu (L), L-Trp (W), L-Met (M), L-Ala (A) and L-Tyr (Y).

As used herein, "aromatic amino acid or residue" refers to a hydrophilic or hydrophobic amino acid or residue having a side chain that includes at least one aromatic or heteroaromatic ring. Genetically encoded aromatic amino acids include L-Phe (F), L-Tyr (Y) and L-Trp (W). Although owing to the pKa of its heteroaromatic nitrogen atom, L-His (H) is sometimes classified as a basic residue, or as an aromatic residue as its side chain includes a heteroaromatic ring; herein histidine is classified as a hydrophilic residue or as a "constrained residue" (see below).

As used herein, "constrained amino acid or residue" refers to an amino acid or residue that has a constrained geometry. Herein, constrained residues include L-Pro (P) and L-His (H). Histidine has a constrained geometry because it has a relatively small imidazole ring. Proline has a constrained geometry because it also has a five membered ring.

As used herein, "non-polar amino acid or residue" refers to a hydrophobic amino acid or residue having a side chain that is uncharged at physiological pH and which has bonds in which the pair of electrons shared in common by two atoms is generally held equally by each of the two atoms (i.e., the side chain is not polar). Genetically encoded non-polar amino acids include L-Gly (G), L-Leu (L), L-Val (V), L-Ile (I), L-Met (M) and L-Ala (A).

As used herein, "aliphatic amino acid or residue" refers to a hydrophobic amino acid or residue having an aliphatic hydrocarbon side chain. Genetically encoded aliphatic amino acids include L-Ala (A), L-Val (V), L-Leu (L) and L-Ile (I). It is noted that cysteine (or "L-Cys" or "[C]") is unusual in that it can form disulfide bridges with other L-Cys (C) amino acids or other sulfanyl- or sulfhydryl-containing amino acids. The "cysteine-like residues" include cysteine and other amino acids that contain sulfhydryl moieties that are available for formation of disulfide bridges. The ability of L-Cys (C) (and other amino acids with —SH containing side chains) to exist in a peptide in either the reduced free —SH or oxidized disulfide-bridged form affects whether L-Cys (C) contributes net hydrophobic or hydrophilic character to a peptide. While L-Cys (C) exhibits a hydrophobicity of 0.29 according to the normalized consensus scale of Eisenberg (Eisenberg et al., 1984, supra), it is to be understood that for purposes of the present disclosure, L-Cys (C) is categorized into its own unique group.

As used herein, "small amino acid or residue" refers to an amino acid or residue having a side chain that is composed of a total three or fewer carbon and/or heteroatoms (excluding the α-carbon and hydrogens). The small amino acids or residues may be further categorized as aliphatic, non-polar, polar or acidic small amino acids or residues, in accordance with the above definitions. Genetically-encoded small amino acids include L-Ala (A), L-Val (V), L-Cys (C), L-Asn (N), L-Ser (S), L-Thr (T) and L-Asp (D).

As used herein, "hydroxyl-containing amino acid or residue" refers to an amino acid containing a hydroxyl (—OH) moiety. Genetically-encoded hydroxyl-containing amino acids include L-Ser (S) L-Thr (T) and L-Tyr (Y).

As used herein, "polynucleotide" and "nucleic acid' refer to two or more nucleotides that are covalently linked together. The polynucleotide may be wholly comprised of ribonucleotides (i.e., RNA), wholly comprised of 2' deoxyribonucleotides (i.e., DNA), or comprised of mixtures of ribo- and 2' deoxyribonucleotides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. In some embodiments, such modified or synthetic nucleobases are nucleobases encoding amino acid sequences.

As used herein, "nucleoside" refers to glycosylamines comprising a nucleobase (i.e., a nitrogenous base), and a 5-carbon sugar (e.g., ribose or deoxyribose). Non-limiting examples of nucleosides include cytidine, uridine, adenosine, guanosine, thymidine, and inosine. In contrast, the term "nucleotide" refers to the glycosylamines comprising a nucleobase, a 5-carbon sugar, and one or more phosphate groups. In some embodiments, nucleosides can be phosphorylated by kinases to produce nucleotides.

As used herein, "nucleoside diphosphate" refers to glycosylamines comprising a nucleobase (i.e., a nitrogenous base), a 5-carbon sugar (e.g., ribose or deoxyribose), and a diphosphate (i.e., pyrophosphate) moiety. In some embodiments herein, "nucleoside diphosphate" is abbreviated as "NDP". Non-limiting examples of nucleoside diphosphates include cytidine diphosphate (CDP), uridine diphosphate (UDP), adenosine diphosphate (ADP), guanosine diphosphate (GDP), thymidine diphosphate (TDP), and inosine diphosphate (IDP). In some embodiments, "nucleoside diphosphate" may refer to a non-natural nucleoside diphosphate, such as compound (5). The terms "nucleoside" and "nucleotide" may be used interchangeably in some contexts.

As used herein, "nucleoside triphosphate" refers to glycosylamines comprising a nucleobase (i.e., a nitrogenous base), a 5-carbon sugar (e.g., ribose or deoxyribose), and a triphosphate moiety. In some embodiments herein, "nucleoside triphosphate" is abbreviated as "NTP". Non-limiting examples of nucleoside triphosphates include cytidine triphosphate (CTP), uridine triphosphate (UTP), adenosine triphosphate (ATP), guanosine triphosphate (GTP), thymidine triphosphate (TTP), and inosine triphosphate (ITP). In some embodiments, "nucleoside triphosphate" may refer to a non-natural nucleoside triphosphate, such as compound (2) and/or compound (3). The terms "nucleoside" and "nucleotide" may be used interchangeably in some contexts.

As used herein, "coding sequence" refers to that portion of a nucleic acid (e.g., a gene) that encodes an amino acid sequence of a protein.

As used herein, the terms "biocatalysis," "biocatalytic," "biotransformation," and "biosynthesis" refer to the use of enzymes to perform chemical reactions on organic compounds.

As used herein, "wild-type" and "naturally occurring" refer to the form found in nature. For example, a wild-type polypeptide or polynucleotide sequence is a sequence present in an organism that can be isolated from a source in nature and which has not been intentionally modified by human manipulation.

As used herein, "recombinant," "engineered," "variant," "non-natural," and "non-naturally occurring" when used with reference to a cell, nucleic acid, or polypeptide, refers to a material, or a material corresponding to the natural or native form of the material, that has been modified in a manner that would not otherwise exist in nature. In some embodiments, the cell, nucleic acid or polypeptide is identical a naturally occurring cell, nucleic acid or polypeptide, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

The term "percent (%) sequence identity" is used herein to refer to comparisons among polynucleotides or polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted by any suitable method, including, but not limited to the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See Altschul et al., J. Mol. Biol., 215: 403-410 [1990]; and Altschul et al., Nucl. Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a word length (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison WI), using default parameters provided.

As used herein, "reference sequence" refers to a defined sequence used as a basis for a sequence and/or activity comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptides are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence.

As used herein, "comparison window" refers to a conceptual segment of at least about 20 contiguous nucleotide positions or amino acid residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "corresponding to," "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered acetate kinase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

As used herein, "substantial identity" refers to a polynucleotide or polypeptide sequence that has at least 80 percent sequence identity, at least 85 percent identity, at least between 89 to 95 percent sequence identity, or more usually, at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In some specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). In some embodiments, residue positions that are not identical in sequences being compared differ by conservative amino acid substitutions.

As used herein, "amino acid difference", "residue difference" and "substitution" refer to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X93 as compared to SEQ ID NO:4" refers to a difference of the amino acid residue at the polypeptide position corresponding to position 93 of SEQ ID NO:4. Thus, if the reference polypeptide of SEQ ID NO:4 has a serine at position 93, then a "residue difference at position X93 as compared to SEQ ID NO:4" refers to an amino acid substitution of any residue other than serine at the position of the polypeptide corresponding to position 93 of SEQ ID NO:4. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in the Tables presented in the Examples), the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, an amino acid residue difference or substitution may be a deletion, which may be denoted by a "−" (e.g. Xn- or H4- to show a deletion of the histidine at position 4. Any such deletion would impact the numbering of the residues after the deletion compared to their position in the sequence listing. Using the example of H4-, the residue at X3 would still be found at position 3, but the residue at position X5 would now be found at position 4 of the sequence listing). In some instances, a polypeptide of the present invention can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X307H/X307P or X307H/P). The slash may also be used to indicate multiple substitutions within a given variant (i.e., there is more than one substitution present in a given sequence, such as in a combinatorial variant). In some embodiments, the present invention includes engineered polypeptide sequences comprising one or more amino acid differences comprising conservative or non-conservative amino acid substitutions. In some additional embodiments, the present invention provides engineered polypeptide sequences comprising both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with an hydroxyl side chain is substituted with another amino acid with an hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered acetate kinase enzyme. Deletions can be directed to the internal portions and/or terminal portions of the polypeptide. In various embodiments, the deletion can comprise a continuous segment or can be discontinuous. Deletions are typically indicated by "-" in amino acid sequences.

As used herein, "insertion" refers to modification to the polypeptide by addition of one or more amino acids to the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

The term "amino acid substitution set" or "substitution set" refers to a group of amino acid substitutions in a polypeptide sequence, as compared to a reference sequence. A substitution set can have 1, 2, 3, 4, 5, 6, 7, 8, 9, 10, 11, 12, 13, 14, 15, or more amino acid substitutions. In some embodiments, a substitution set refers to the set of amino acid substitutions that is present in any of the variant acetate kinases listed in the Tables provided in the Examples.

A "functional fragment" and "biologically active fragment" are used interchangeably herein to refer to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered acetate kinase of the present invention) and that retains substantially all of the activity of the full-length polypeptide.

As used herein, "isolated polypeptide" refers to a polypeptide which is substantially separated from other contaminants that naturally accompany it (e.g., protein, lipids, and polynucleotides). The term embraces polypeptides which have been removed or purified from their naturally occurring environment or expression system (e.g., within a host cell or via in vitro synthesis). The recombinant acetate kinase polypeptides may be present within a cell, present in the cellular medium, or prepared in various forms, such as lysates or isolated preparations. As such, in some embodiments, the recombinant acetate kinase polypeptides can be an isolated polypeptide.

As used herein, "substantially pure polypeptide" or "purified protein" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. However, in some embodiments, the composition comprising acetate kinase comprises acetate kinase that is less than 50% pure (e.g., about 10%, about 20%, about 30%, about 40%, or about 50%). Generally, a substantially pure acetate kinase composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant acetate kinase polypeptides are substantially pure polypeptide compositions.

As used herein, "improved enzyme property" refers to at least one improved property of an enzyme. In some embodiments, the present invention provides engineered acetate kinase polypeptides that exhibit an improvement in any enzyme property as compared to a reference acetate kinase polypeptide and/or a wild-type acetate kinase polypeptide, and/or another engineered acetate kinase polypeptide. Thus, the level of "improvement" can be determined and compared between various acetate kinase polypeptides, including wild-type, as well as engineered acetate kinases. Improved properties include, but are not limited, to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic pH, increased tolerance to proteolytic activity (i.e., reduced sensitivity to proteolysis), reduced aggregation, increased solubility, and altered temperature profile. In additional embodiments, the term is used in reference to the at least one improved property of acetate kinase enzymes. In some embodiments, the present invention provides acetate kinase polypeptides that exhibit an improvement in any enzyme property as compared to a reference acetate kinase polypeptide and/or a wild-type acetate kinase polypeptide, and/or another engineered acetate kinase polypeptide. Thus, the level of "improvement" can be determined and compared between various acetate kinase polypeptides, including wild-type, as well as engineered acetate kinases.

As used herein, "increased enzymatic activity" and "enhanced catalytic activity" refer to an improved property of the engineered polypeptides, which can be represented by an increase in specific activity (e.g., product produced/time/weight protein) or an increase in percent conversion of the substrate to the product (e.g., percent conversion of starting amount of substrate to product in a specified time period using a specified amount of enzyme) as compared to the reference enzyme. In some embodiments, the terms refer to an improved property of engineered acetate kinase polypeptides provided herein, which can be represented by an increase in specific activity (e.g., product produced/time/weight protein) or an increase in percent conversion of the substrate to the product (e.g., percent conversion of starting amount of substrate to product in a specified time period using a specified amount of acetate kinase) as compared to the reference acetate kinase enzyme. In some embodiments, the terms are used in reference to improved acetate kinase enzymes provided herein. Exemplary methods to determine enzyme activity of the engineered acetate kinases of the present invention are provided in the Examples. Any property relating to enzyme activity may be affected, including the classical enzyme properties of $K_m$, $V_{max}$ or $k_{cat}$, changes of which can lead to increased enzymatic activity. For example, improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring acetate kinase or another engineered acetate kinase from which the acetate kinase polypeptides were derived.

As used herein, "conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of an acetate kinase polypeptide can be expressed as "percent conversion" of the substrate to the product in a specific period of time.

Enzymes with "generalist properties" (or "generalist enzymes") refer to enzymes that exhibit improved activity for a wide range of substrates, as compared to a parental sequence. Generalist enzymes do not necessarily demonstrate improved activity for every possible substrate. In some embodiments, the present invention provides acetate kinase variants with generalist properties, in that they demonstrate similar or improved activity relative to the parental gene for a wide range of sterically and electronically diverse substrates. In addition, the generalist enzymes provided herein were engineered to be improved across a wide range of diverse molecules to increase the production of metabolites/products.

The term "stringent hybridization conditions" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (See e.g., Baldino et al., Meth. Enzymol., 168:761-777 [1989]; Bolton et al., Proc. Natl. Acad. Sci. USA 48:1390 [1962]; Bresslauer et al., Proc. Natl. Acad. Sci. USA 83:8893-8897 [1986]; Freier et al., Proc. Natl. Acad. Sci. USA 83:9373-9377 [1986]; Kierzek et al., Biochem., 25:7840-7846 [1986]; Rychlik et al., Nucl. Acids Res., 18:6409-6412 [1990] (erratum, Nucl. Acids Res., 19:698 [1991]); Sambrook et al., supra); Suggs et al., 1981, in *Developmental Biology Using Purified Genes*, Brown et al. [eds.], pp. 683-693, Academic Press, Cambridge, MA [1981]; and Wetmur, Crit. Rev. Biochem. Mol. Biol. 26:227-259 [1991]). In some embodiments, the polynucleotide encodes the polypeptide disclosed herein and hybridizes under defined conditions, such as moderately stringent or highly stringent conditions, to the complement of a sequence encoding an engineered acetate kinase enzyme of the present invention.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w/v) SDS at 65° C. and washing in 0.1×SSC containing 0.1% SDS at 65° C. Other high stringency hybridization conditions, as well as moderately stringent conditions, are described in the references cited above.

As used herein, "codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the acetate kinase enzymes may be codon optimized for optimal production in the host organism selected for expression.

As used herein, "preferred," "optimal," and "high codon usage bias" codons when used alone or in combination refer(s) interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, Peden, University of Nottingham; McInerney, Bioinform., 14:372-73 [1998]; Stenico et al., Nucl. Acids Res., 222437-46 [1994]; and Wright, Gene 87:23-29 [1990]). Codon usage tables are available for many different organisms (See e.g., Wada et al., Nucl. Acids Res., 20:2111-2118 [1992]; Nakamura et al., Nucl. Acids Res., 28:292 [2000]; Duret, et al., supra; Henaut and Danchin, in *Escherichia coli* and *Salmonella*, Neidhardt, et al. (eds.), ASM Press, Washington, D.C., p. 2047-2066 [1996]). The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Mount, *Bioinformatics: Sequence and Genome Analysis*, Chapter 8, Cold Spring Harbor Laboratory Press, Cold Spring Harbor, N.Y. [2001]; Uberbacher, Meth. Enzymol., 266:259-281 [1996]; and Tiwari et al., Comput. Appl. Biosci., 13:263-270 [1997]).

As used herein, "control sequence" includes all components, which are necessary or advantageous for the expression of a polynucleotide and/or polypeptide of the present invention. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

The phrase "suitable reaction conditions" refers to those conditions in the enzymatic conversion reaction solution (e.g., ranges of enzyme loading, substrate loading, temperature, pH, buffers, co-solvents, etc.) under which an acetate kinase polypeptide of the present invention is capable of converting a substrate to the desired product compound. Some exemplary "suitable reaction conditions" are provided herein.

As used herein, "loading," such as in "compound loading" or "enzyme loading" refers to the concentration or amount of a component in a reaction mixture at the start of the reaction.

As used herein, "substrate" in the context of an enzymatic conversion reaction process refers to the compound or molecule acted on by the engineered enzymes provided herein (e.g., engineered acetate kinase polypeptides).

As used herein, "increasing" yield of a product (e.g., a nucleoside triphosphate or analogue) from a reaction occurs when a particular component present during the reaction (e.g., an acetate kinase enzyme) causes more product to be produced, compared with a reaction conducted under the same conditions with the same substrate and other substituents, but in the absence of the component of interest.

A reaction is said to be "substantially free" of a particular enzyme if the amount of that enzyme compared with other enzymes that participate in catalyzing the reaction is less than about 2%, about 1%, or about 0.1% (wt/wt).

As used herein, "fractionating" a liquid (e.g., a culture broth) means applying a separation process (e.g., salt precipitation, column chromatography, size exclusion, and filtration) or a combination of such processes to provide a solution in which a desired protein comprises a greater percentage of total protein in the solution than in the initial liquid product.

As used herein, "starting composition" refers to any composition that comprises at least one substrate. In some embodiments, the starting composition comprises any suitable substrate.

As used herein, "product" in the context of an enzymatic conversion process refers to the compound or molecule resulting from the action of an enzymatic polypeptide on a substrate.

As used herein, "equilibration" as used herein refers to the process resulting in a steady state concentration of chemical species in a chemical or enzymatic reaction (e.g., interconversion of two species A and B), including interconversion of stereoisomers, as determined by the forward rate constant and the reverse rate constant of the chemical or enzymatic reaction.

As used herein, "alkyl" refers to saturated hydrocarbon groups of from 1 to 18 carbon atoms inclusively, either straight chained or branched, more preferably from 1 to 8 carbon atoms inclusively, and most preferably 1 to 6 carbon atoms inclusively. An alkyl with a specified number of carbon atoms is denoted in parenthesis (e.g., (C1-C4)alkyl refers to an alkyl of 1 to 4 carbon atoms).

As used herein, "alkenyl" refers to groups of from 2 to 12 carbon atoms inclusively, either straight or branched containing at least one double bond but optionally containing more than one double bond.

As used herein, "alkynyl" refers to groups of from 2 to 12 carbon atoms inclusively, either straight or branched containing at least one triple bond but optionally containing more than one triple bond, and additionally optionally containing one or more double bonded moieties.

As used herein, "heteroalkyl, "heteroalkenyl," and heteroalkynyl," refer to alkyl, alkenyl and alkynyl as defined herein in which one or more of the carbon atoms are each independently replaced with the same or different heteroatoms or heteroatomic groups. Heteroatoms and/or heteroatomic groups which can replace the carbon atoms include, but are not limited to, —O—, —S—, —S—O—, —NRα-, —PH—, —S(O)—, —S(O)2-, —S(O) NRα-, —S(O) 2NRα-, and the like, including combinations thereof, where each Rα is independently selected from hydrogen, alkyl, heteroalkyl, cycloalkyl, heterocycloalkyl, aryl, and heteroaryl.

As used herein, "alkoxy" refers to the group —ORβ wherein Rβ is an alkyl group is as defined above including optionally substituted alkyl groups as also defined herein.

As used herein, "aryl" refers to an unsaturated aromatic carbocyclic group of from 6 to 12 carbon atoms inclusively having a single ring (e.g., phenyl) or multiple condensed rings (e.g., naphthyl or anthryl). Exemplary aryls include phenyl, pyridyl, naphthyl and the like.

As used herein, "amino" refers to the group —NH2. Substituted amino refers to the group —NHRδ, NRδRδ, and NRδRδRδ, where each Rδ is independently selected from substituted or unsubstituted alkyl, cycloalkyl, cycloheteroalkyl, alkoxy, aryl, heteroaryl, heteroarylalkyl, acyl, alkoxycarbonyl, sulfanyl, sulfinyl, sulfonyl, and the like. Typical amino groups include, but are limited to, dimethylamino, diethylamino, trimethylammonium, triethylammonium, methylsulfonylamino, furanyl-oxy-sulfamino, and the like.

As used herein, "oxo" refers to =O.

As used herein, "oxy" refers to a divalent group —O—, which may have various substituents to form different oxy groups, including ethers and esters.

As used herein, "carboxy" refers to —COOH.

As used herein, "carbonyl" refers to —C(O)—, which may have a variety of substituents to form different carbonyl groups including acids, acid halides, aldehydes, amides, esters, and ketones.

As used herein, "alkyloxycarbonyl" refers to —C(O)ORε, where Rε is an alkyl group as defined herein, which can be optionally substituted.

As used herein, "aminocarbonyl" refers to —C(O)NH2. Substituted aminocarbonyl refers to —C(O)NRδRδ, where the amino group NRδRδ is as defined herein.

As used herein, "halogen" and "halo" refer to fluoro, chloro, bromo and iodo.

As used herein, "hydroxy" refers to —OH.

As used herein, "cyano" refers to —CN.

As used herein, "heteroaryl" refers to an aromatic heterocyclic group of from 1 to 10 carbon atoms inclusively and 1 to 4 heteroatoms inclusively selected from oxygen, nitrogen and sulfur within the ring. Such heteroaryl groups can have a single ring (e.g., pyridyl or furyl) or multiple condensed rings (e.g., indolizinyl or benzothienyl).

As used herein, "heteroarylalkyl" refers to an alkyl substituted with a heteroaryl (i.e., heteroaryl-alkyl-groups), preferably having from 1 to 6 carbon atoms inclusively in the alkyl moiety and from 5 to 12 ring atoms inclusively in the heteroaryl moiety. Such heteroarylalkyl groups are exemplified by pyridylmethyl and the like.

As used herein, "heteroarylalkenyl" refers to an alkenyl substituted with a heteroaryl (i.e., heteroaryl-alkenyl-groups), preferably having from 2 to 6 carbon atoms inclusively in the alkenyl moiety and from 5 to 12 ring atoms inclusively in the heteroaryl moiety.

As used herein, "heteroarylalkynyl" refers to an alkynyl substituted with a heteroaryl (i.e., heteroaryl-alkynyl-groups), preferably having from 2 to 6 carbon atoms inclusively in the alkynyl moiety and from 5 to 12 ring atoms inclusively in the heteroaryl moiety.

As used herein, "heterocycle," "heterocyclic," and interchangeably "heterocycloalkyl," refer to a saturated or unsaturated group having a single ring or multiple condensed rings, from 2 to 10 carbon ring atoms inclusively and from 1 to 4 hetero ring atoms inclusively selected from nitrogen, sulfur or oxygen within the ring. Such heterocyclic groups can have a single ring (e.g., piperidinyl or tetrahydrofuryl) or multiple condensed rings (e.g., indolinyl, dihydrobenzofuran or quinuclidinyl). Examples of heterocycles include, but are not limited to, furan, thiophene, thiazole, oxazole, pyrrole, imidazole, pyrazole, pyridine, pyrazine, pyrimidine, pyridazine, indolizine, isoindole, indole, indazole, purine, quinolizine, isoquinoline, quinoline, phthalazine, naphthylpyridine, quinoxaline, quinazoline, cinnoline, pteridine, carbazole, carboline, phenanthridine, acridine, phenanthroline, isothiazole, phenazine, isoxazole, phenoxazine, phenothiazine, imidazolidine, imidazoline, piperidine, piperazine, pyrrolidine, indoline and the like.

As used herein, "membered ring" is meant to embrace any cyclic structure. The number preceding the term "membered" denotes the number of skeletal atoms that constitute the ring. Thus, for example, cyclohexyl, pyridine, pyran and thiopyran are 6-membered rings and cyclopentyl, pyrrole, furan, and thiophene are 5-membered rings.

Unless otherwise specified, positions occupied by hydrogen in the foregoing groups can be further substituted with substituents exemplified by, but not limited to, hydroxy, oxo, nitro, methoxy, ethoxy, alkoxy, substituted alkoxy, trifluoromethoxy, haloalkoxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkoxyalkyl, thio, alkylthio, acyl, carboxy, alkoxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle)alkyl; and preferred heteroatoms are oxygen, nitrogen, and sulfur. It is understood that where open valences exist on these substituents they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further understood that the above substitutions can be made provided that replacing the hydrogen with the substituent does not introduce unacceptable instability to the molecules of the present invention, and is otherwise chemically reasonable.

As used herein the term "culturing" refers to the growing of a population of microbial cells under any suitable conditions (e.g., using a liquid, gel or solid medium).

In some embodiments, "recombinant acetate kinase polypeptides" (also referred to herein as "engineered acetate kinase polypeptides," "variant acetate kinase enzymes," "acetate kinase variants," and "acetate kinase combinatorial variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature. For example, a "heterologous polynucleotide" is any polynucleotide that is introduced into a host cell by laboratory techniques, and includes polynucleotides that are removed from a host cell, subjected to laboratory manipulation, and then reintroduced into a host cell.

As used herein, the terms "host cell" and "host strain" refer to suitable hosts for expression vectors comprising DNA provided herein (e.g., the polynucleotides encoding the acetate kinase variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues means polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues. The term "analogue," when used in reference to a chemical structure or compound, refers to a similar chemical structure or compound, wherein one or more substituents or chemical groups have been substituted as compared to the reference chemical structure or compound.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

As used herein, "stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess ("e.e.") calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess ("d.e."). Enantiomeric excess and diastereomeric excess are types of stereomeric excess.

As used herein, "regioselectivity" and "regioselective reaction" refer to a reaction in which one direction of bond making or breaking occurs preferentially over all other possible directions. Reactions can completely (100%) regioselective if the discrimination is complete, substantially regioselective (at least 75%), or partially regioselective (x %, wherein the percentage is set dependent upon the reaction of interest), if the product of reaction at one site predominates over the product of reaction at other sites.

As used herein, "chemoselectivity" refers to the preferential formation in a chemical or enzymatic reaction of one product over another.

As used herein, "pH stable" refers to an acetate kinase polypeptide that maintains similar activity (e.g., more than 60% to 80%) after exposure to high or low pH (e.g., 4.5-6 or 8 to 12) for a period of time (e.g., 0.5-24 hrs) compared to the untreated enzyme.

As used herein, "thermostable" refers to an acetate kinase polypeptide that maintains similar activity (more than 60% to 80% for example) after exposure to elevated temperatures (e.g., 40-80° C.) for a period of time (e.g., 0.5-24 h) compared to the wild-type enzyme exposed to the same elevated temperature.

As used herein, "solvent stable" refers to an acetate kinase polypeptide that maintains similar activity (more than e.g., 60% to 80%) after exposure to varying concentrations (e.g., 5-99%) of solvent (ethanol, isopropyl alcohol, dimethylsulfoxide [DMSO], tetrahydrofuran, 2-methyltetrahydrofuran, acetone, toluene, butyl acetate, methyl tert-butyl ether, etc.) for a period of time (e.g., 0.5-24 h) compared to the wild-type enzyme exposed to the same concentration of the same solvent.

As used herein, "thermo- and solvent stable" refers to an acetate kinase polypeptide that is both thermostable and solvent stable.

As used herein, "optional" and "optionally" mean that the subsequently described event or circumstance may or may not occur, and that the description includes instances where the event or circumstance occurs and instances in which it does not. One of ordinary skill in the art would understand that with respect to any molecule described as containing one or more optional substituents, only sterically practical and/or synthetically feasible compounds are meant to be included.

As used herein, "optionally substituted" refers to all subsequent modifiers in a term or series of chemical groups. For example, in the term "optionally substituted arylalkyl, the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

DETAILED DESCRIPTION OF THE INVENTION

The present invention provides engineered acetate kinase (AcK) enzymes, polypeptides having AcK activity, and polynucleotides encoding these enzymes, as well as vectors and host cells comprising these polynucleotides and polypeptides. Methods for producing AcK enzymes are also provided. The present invention further provides compositions comprising the AcK enzymes and methods of using the engineered AcK enzymes. The present invention finds particular use in the production of pharmaceutical compounds.

In some embodiments, the present invention provides enzymes suitable for the production of cyclic dinucleotides, such as cGAMP. The present invention was developed in order to address the potential use of enzymes to produce these cyclic dinucleotides. In some embodiments, the present invention provides enzymes that are useful in producing compounds that result in methods for the in vitro enzymatic synthesis of the non-natural cyclic dinucleotide of compound (1).

Compound (1)

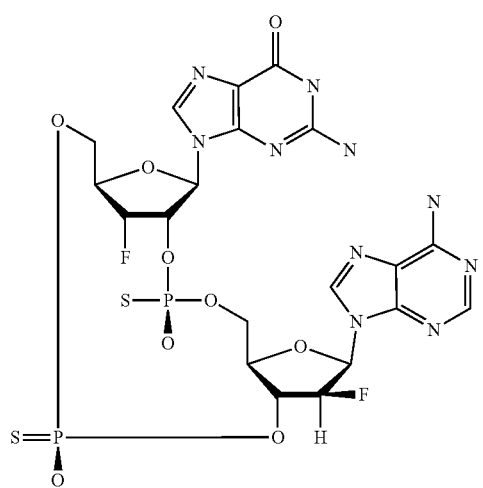

(1)

In some embodiments, the present invention provides engineered enzymes suitable for the production of nucleoside triphosphates. In some embodiments, the present invention provides engineered enzymes suitable for the production of nonnatural nucleoside triphosphates. In some embodiments, the nonnatural nucleoside triphosphate is a thio and/or fluorinated nucleoside triphosphate. In some embodiments, the non-natural nucleoside triphosphate is Sp-3'Fluoro-3'-deoxyguanosine-5'-(1-thio)-triphosphate (F-thioGTP or compound (2)) and/or Sp-2'Fluoro-ara-adenosine-5'-(1-thio)-triphosphate (F-thioATP or compound (3)).

In some embodiments, the engineered enzymes produce nucleoside triphosphates. In some embodiments, the nucleoside diphosphates are substrates for an acetate kinase that produces nucleoside triphosphates. In some embodiments, the engineered enzymes produce nucleoside triphosphates from nucleoside diphosphates. In some embodiments, the present invention provides enzymes that are useful in producing compounds for the in vitro enzymatic synthesis of the non-natural nucleoside triphosphate of compound (2). In some embodiments, the present invention provides enzymes that are useful in producing compounds for the in vitro enzymatic synthesis of the non-natural nucleoside triphosphate of compound (3). In some embodiments, the present invention provides enzymes that are useful in producing compound (2) and/or compound (3), which are converted through in vitro enzymatic synthesis to the non-natural cyclic dinucleotide of compound (1).

Non-natural derivatives of cGAMP, including compound (1), are being investigated in cancer therapy. cGAMP, a cyclic dinucleotide, is known to function as a second messenger that stimulates innate immunity through the endoplasmic reticulum sensor STING. cGAMP activation of STING was demonstrated to have an anti-tumor effect in mice through induction of production of interferon and stimulation of dendritic cells (Li et al., Sci. Rep. 6:19049 [2016]) cGAMP is produced in response to double-stranded DNA (dsDNA) by cyclic GMP-AMP synthase (cGAS) (Gao et al., Cell. 153:1094-1107 [2013]), which functions as a cellular sensor of foreign nucleic acids. cGAS activity requires binding of dsDNA, with single-stranded (ssDNA) or RNA ligands producing only weak or no activity, respectively. Binding to dsDNA induces conformational changes in cGAS to the active enzyme state (Kranzusch et al., Cell Rep. 3(5): 1362-1368 [2013]).

Several cGAS crystal structures have been generated, including murine and human cGAS. These crystal structures reveal several conserved domains, including a nucleotidyltransferase core, a zinc finger domain, and a C-terminal domain (Gao et al., Cell. 153(5): 1094-1107 [2013]; Kranzusch et al., Cell Rep. 3(5): 1362-1368 [2013]). In addition to bound dsDNA, cGAS requires a divalent metal cation (typically $Mn^{2+}$ or $Mg^{2+}$) for activity. cGAS is capable of producing several diastereomeric forms of cGAMP, depending on whether (s) or (r) nucleoside triphosphates are used as substrates. The desired diastereomeric form is (r,r) (compound (1)), which is produced by cGAS conversion of Sp-3'Fluoro-3'-deoxyguanosine-5'-(1-thio)-triphosphate (F-thioGTP or compound (2)) and Sp-2'Fluoro-ara-adenosine-5'-1-thio-triphosphate (F-thioATP or compound (3)).

Scheme 1: Production of Compound (1) by cGAS
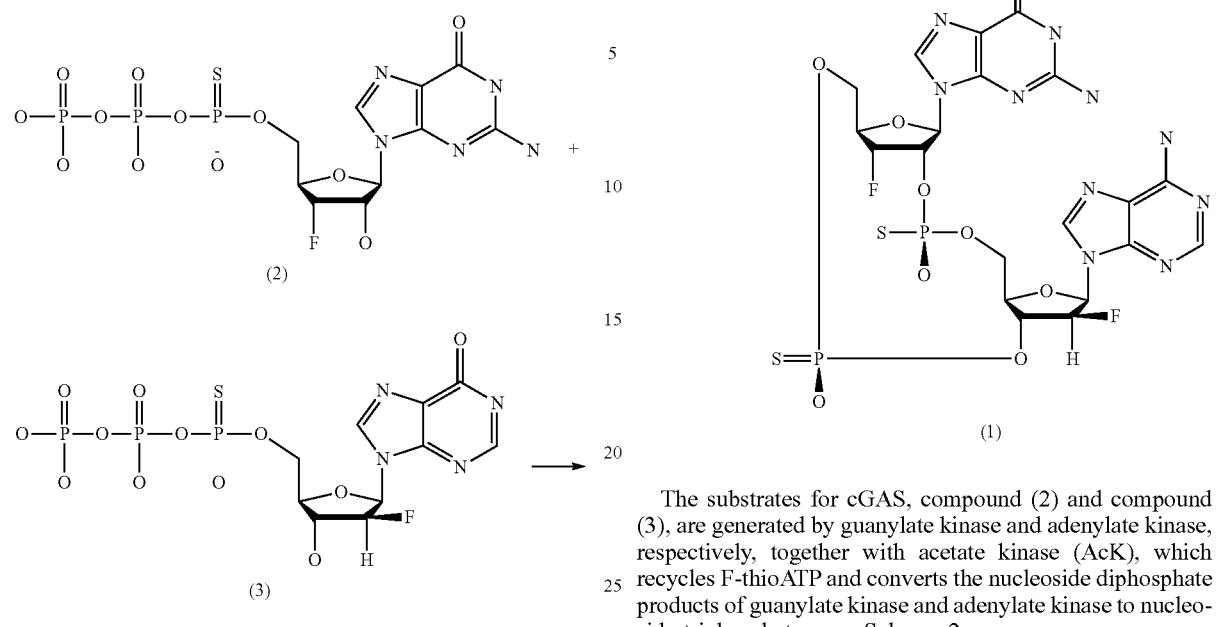
(2)
(3)
(1)
The substrates for cGAS, compound (2) and compound (3), are generated by guanylate kinase and adenylate kinase, respectively, together with acetate kinase (AcK), which recycles F-thioATP and converts the nucleoside diphosphate products of guanylate kinase and adenylate kinase to nucleoside triphosphates; see Scheme 2.

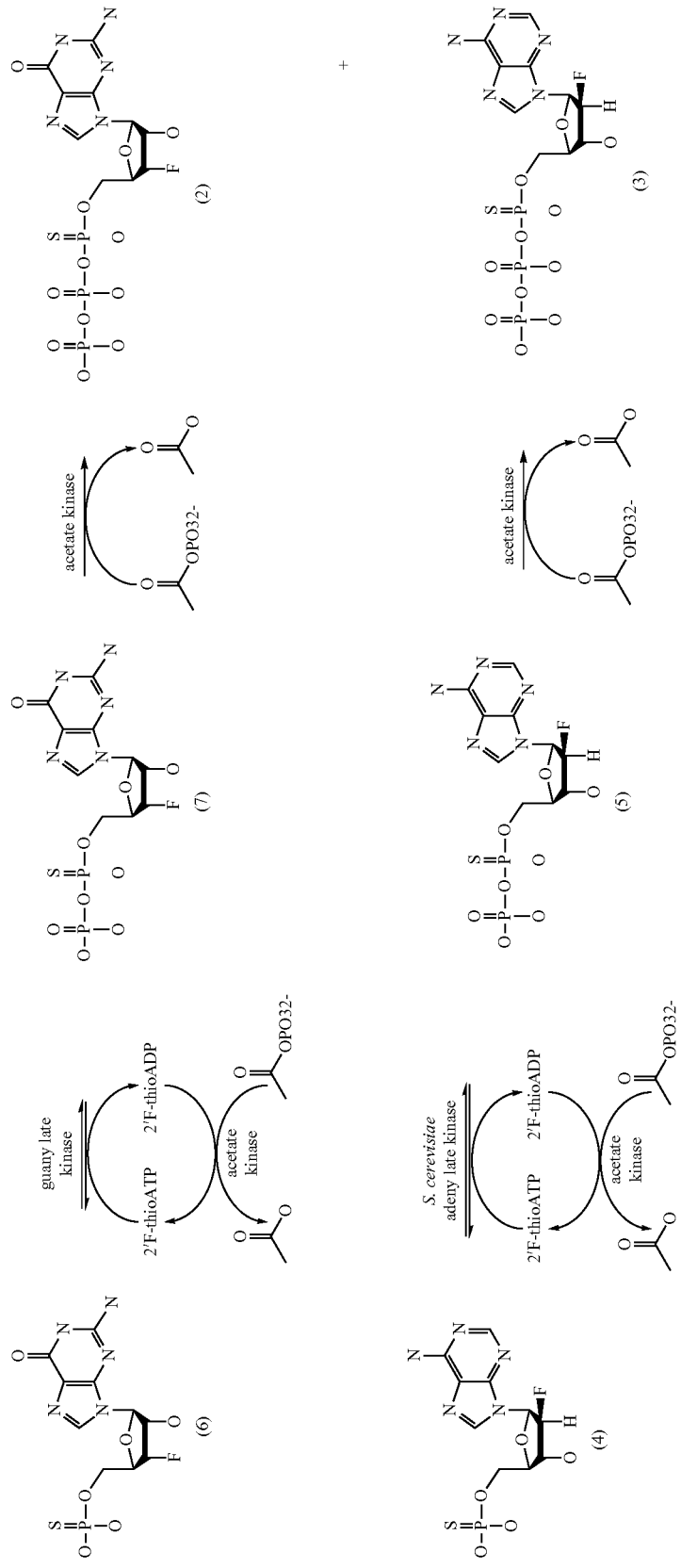

-continued
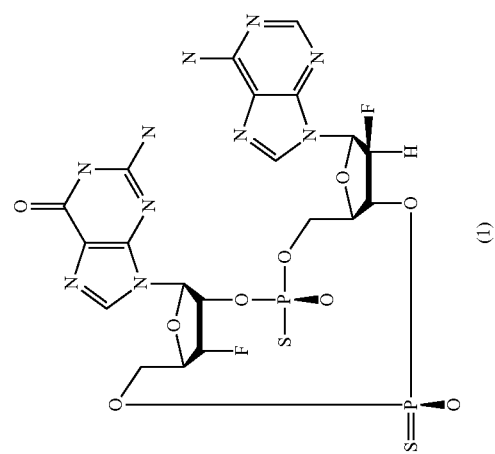
(1)

In the first step, AdK converts Sp-2'Fluoro-ara-adenosine-5'-(1-thio)-monophosphate (F-thioAMP or compound (4)) to Sp-2'Fluoro-ara-adenosine-5'-(1-thio)-diphosphate (F-thio-ADP or compound (5)) using F-thioATP, compound (3), as the phosphate donor. Two molecules of F-thioADP, compound (5), are generated for each substrate molecule of F-thioAMP, compound (4). One F-thioADP (5) is recycled by AcK to F-thioATP (3), which is consumed by the reaction. The same AcK subsequently transforms the second F-thioADP (5) using acetyl phosphate as the phosphate donor to the final product F-thioATP (3); see Scheme 3, below.

Scheme 3: Production of F-thioATP Compound (3) by Adenylate Kinase and Acetate Kinase

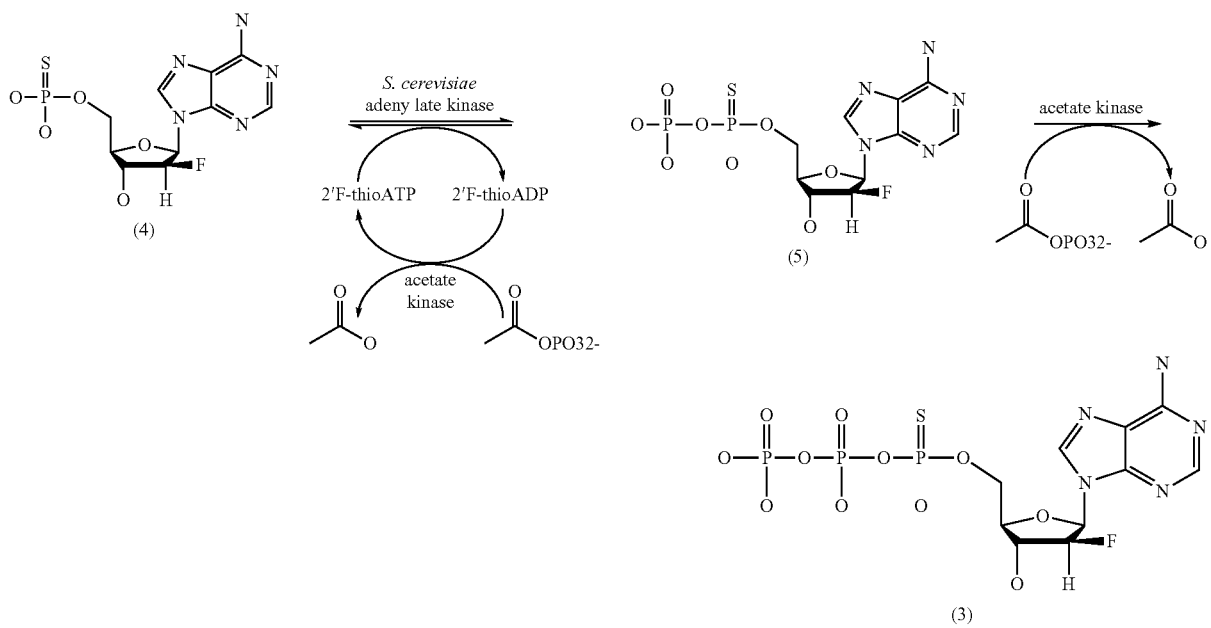

Similarly, GK converts Sp-3'Fluoro-3'-deoxyguanosine-5'-(1-thio)-monophosphate (F-thioGMP or compound (6)) to Sp-3'Fluoro-3'-deoxyguanosine-5'-(1-thio)-diphosphate (F-thioGDP or compound (7)) using F-thioATP, compound (3), as the phosphate donor. One molecule of F-thioGDP, compound (7), and one molecule of F-thioADP, compound (5), are generated for each substrate molecule of F-thioGMP, compound (6). The F-thioADP (5) is recycled by AcK to F-thioATP (3), which is consumed by the reaction. The same AcK subsequently transforms the F-thioGDP (7) using acetyl phosphate as the phosphate donor to the final product F-thioGTP (2); see Scheme 4, below.

Scheme 4: Production of F-thioGTP Compound (2) by Guanylate Kinase and Acetate Kinase

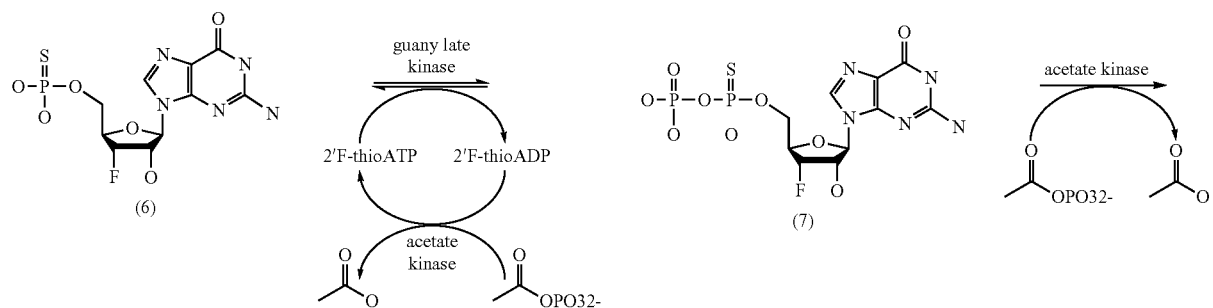

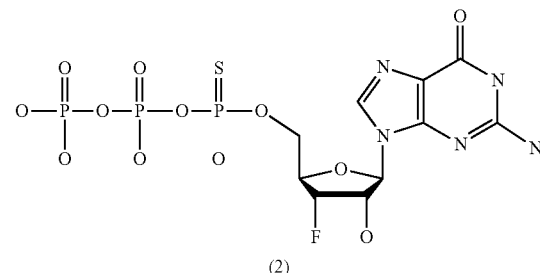

(2)

Acetate kinase (EC 2.7.2.1) is a basic metabolic enzyme found primarily in prokaryotes. The thermostable acetate kinase from *Thermotoga maritima* has been crystalized to a resolution of 3.30 Å (PDB ID: 2IIR. W. Mukhopadhyay, S., Hasson, M. S., Sanders, D. A. [2007] Acetate kinase from a hypothermophile *Thermotoga maritima*. DOI: 10.2210/pdb2IIR/pdb). Acetate kinase facilitates the phosphorylation of acetate to acetyl-CoA in the presence of ATP, and is, thus, a significant enzyme in bacterial metabolic cycling (Schönheit & Schäfer T., World J Microbiol Biotechnol. 11(1):26-57. [1995]). Acetate kinase is also capable of phosporylating nucleoside diphosphates to nucleoside triphosphates.

However, the wild-type acetate kinase (AcK) from *M. thermotoga* possesses only limited activity towards conversion of the non-natural substrates of F-thioADP (5) and F-thioGDP (7) to F-thioATP (3) and F-thioGTP (2), respectively, using acetyl phosphate as the phosphate donor. Therefore, AcK enzymes with improved activity are necessary to generate F-thioATP (3) and F-thioGTP (2), the substrates for cGAS conversion to product compound (1). Engineered AcKs that have improved activity and that operate under typical industrial conditions and/or as part of multi-enzyme systems are necessary. The present invention addresses this need and provides engineered AcKs that are suitable for use in these and other reactions under industrial conditions.

Engineered AcK Polypeptides

The present invention provides engineered AcK polypeptides, polynucleotides encoding the polypeptides, methods of preparing the polypeptides, and methods for using the polypeptides. Where the description relates to polypeptides, it is to be understood that it also describes the polynucleotides encoding the polypeptides. In some embodiments, the present invention provides engineered, non-naturally occurring AcK enzymes with improved properties as compared to wild-type AcK enzymes.

In some embodiments, the present invention provides engineered acetate kinases, wherein the engineered acetate kinases comprise polypeptide sequences that are at least 85%, 86%, 87%, 88%, 89%, 90%, 91%, 92%, 93%, 94%, 95%, 96%, 97%, 98%, 99% or more identical to SEQ ID NO: 2 and/or 4. In some embodiments, the engineered acetate kinase comprises a variant engineered acetate kinase set forth in SEQ ID NO: 4.

In some additional embodiments, the present invention provides engineered acetate kinases, wherein the engineered acetate kinases comprise polypeptide sequences that are at least 85%, 86%, 87%, 88%, 89%, 90%, 91%, 92%, 93%, 94%, 95%, 96%, 97%, 98%, 99% or more identical to the sequence of at least one engineered acetate kinase variant set forth in Table 2-1, 3-1, 4-1, and/or 5-1.

The present invention also provides engineered acetate kinases wherein the engineered acetate kinases comprise polypeptide sequences that are at least 85%, 86%, 87%, 88%, 89%, 90%, 91%, 92%, 93%, 94%, 95%, 96%, 97%, 98%, 99% or more identical to the sequence of at least one engineered acetate kinase variant set forth in the even numbered sequences of SEQ ID NOs: 4-550.

The present invention further provides engineered acetate kinases, wherein said engineered acetate kinases comprise at least one improved property compared to wild-type *Thermotoga maritima* acetate kinase. In some embodiments, the improved property comprises improved activity on a substrate. In some further embodiments, the substrate comprises F-thioADP (5) and/or F-thioGDP (7). In some additional embodiments, the improved property comprises improved production of F-thioATP (3) and/or F-thioGTP (2). In yet some additional embodiments, the engineered acetate kinase is purified. The present invention also provides compositions comprising at least one engineered acetate kinase provided herein.

As will be appreciated by the skilled artisan, in some embodiments, one or a combination of residue differences above that is selected can be kept constant (i.e., maintained) in the engineered acetate kinases as a core feature, and additional residue differences at other residue positions incorporated into the sequence to generate additional engineered acetate kinase polypeptides with improved properties. Accordingly, it is to be understood for any engineered acetate kinase containing one or a subset of the residue differences above, the present invention contemplates other engineered acetate kinases that comprise the one or subset of the residue differences, and additionally one or more residue differences at the other residue positions disclosed herein.

In some embodiments, the engineered acetate kinase polypeptide is capable of converting the substrate compound to product compound with at least 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold, or more activity relative to the activity of the reference polypeptide of SEQ ID NO: 2 and/or 4. In some embodiments, the engineered acetate kinase polypeptide capable of converting the substrate compound to product compound with at least 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold, or more activity relative to the activity of the reference polypeptide of SEQ ID NO: 2 and/or 4, comprises an amino acid sequence having one or more features selected from improved activity, improved specific activity, and/or improved thermostability.

In some embodiments, the engineered acetate kinase polypeptide is capable of converting the substrate compound to product compound with at least 1.2 fold the activity relative to SEQ ID NO: 2 and/or 4, and comprises an amino acid sequence selected from the even-numbered sequences in the following range: SEQ ID NO: 4-550.

In some embodiments, the engineered acetate kinase polypeptide is capable of converting the substrate compound to product compound with at least 2 fold the activity relative to SEQ ID NO: 2 and/or 4, and comprises an amino acid sequence having one or more residue differences as provided herein (as compared to SEQ ID NO: 2 and/or 4, as applicable).

In some embodiments, the engineered acetate kinase polypeptide capable of converting the substrate compound to product compound with at least 2 fold the activity relative to SEQ ID NO: 2 and/or 4, comprises an amino acid sequence selected from the even-numbered sequences in the following range: SEQ ID NO: 4-550.

In some embodiments, the engineered acetate kinase polypeptide is capable of converting at least 50% or more, 60% or more, 70% or more, 89% or more, 90% or more, 91% or more, 92% or more, 93% or more, 94% or more, or 95% or more of substrate compound to product compound in 120 h or less, 72 h or less, 48 h or less, 24h or less, or 3 h or less, at a substrate loading of about 100 g/L, about 40 g/L, or about 20 g/L under HTP assay conditions, under SFP assay conditions, or DSP assay conditions. In some embodiments, the engineered acetate kinase polypeptide is capable of converting at least 95% or more of substrate compound to product compound in 3 h or less at a substrate loading of about 40 g/L under SFP assay conditions at about 25° C. The acetate kinase, at 0.05 g/L, was shown to support ATP recycling up to 70% conversion of 110 mM F-thioAMP, 2 mM F-thioATP, with 4 g/L adenylate kinase (SEQ ID NO: 554), at 25 C, 3 hours. In the guanylate kinase pathway, acetate kinase, at 0.05 g/L, was also shown to support the ATP recycling up to 70% conversion of 80 mM F-thioGMP, 7.3 mM F-thioATP, 4 g/L guanylate kinase, at 25° C., 3 h.

In some embodiments, the engineered polypeptide having acetate kinase activity, comprises an amino acid sequence having at least 80%, 85%, 86%, 87%, 88%, 89%, 90%, 91%, 92%, 93%, 94%, 95%, 96%, 97%, 98%, or 99% identity to one of the even-numbered sequences in the following range: SEQ ID NO: 4-550, and the amino acid residue differences as compared to SEQ ID NO: 2 and/or 550, present in any one of the even-numbered sequences in the following range: SEQ ID NO: 4-550, as provided in Tables 2-1, 3-1, 4-1, and/or 5-1.

In addition to the residue positions specified above, any of the engineered acetate kinase polypeptides disclosed herein can further comprise other residue differences relative to SEQ ID NO: 2 and/or 4, at other residue positions (i.e., residue positions other than those included in any of the even-numbered sequences in the following range: SEQ ID NO: 4-550). Residue differences at these other residue positions can provide for additional variations in the amino acid sequence without adversely affecting the ability of the polypeptide to carry out the conversion of substrate to product. Accordingly, in some embodiments, in addition to the amino acid residue differences present in any one of the engineered acetate kinase polypeptides selected from the even-numbered sequences in the following range: SEQ ID NO: 4-550, the sequence can further comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, or 1-50 residue differences at other amino acid residue positions as compared to the SEQ ID NO: 2 and/or 4. In some embodiments, the number of amino acid residue differences as compared to the reference sequence can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45 or 50 residue positions. In some embodiments, the number of amino acid residue differences as compared to the reference sequence can be 1, 2, 3, 4, 5, 6, 7, 8, 9, 10, 11, 12, 13, 14, 15, 16, 18, 20, 21, 22, 23, 24, or 25 residue positions. The residue difference at these other positions can be conservative changes or non-conservative changes. In some embodiments, the residue differences can comprise conservative substitutions and non-conservative substitutions as compared to acetate kinase polypeptide of SEQ ID NO: 2 and/or 4.

In some embodiments, the present invention also provides engineered polypeptides that comprise a fragment of any of the engineered acetate kinase polypeptides described herein that retains the functional activity and/or improved property of that engineered acetate kinase. Accordingly, in some embodiments, the present invention provides a polypeptide fragment capable of converting substrate compound to product compound under suitable reaction conditions, wherein the fragment comprises at least about 80%, 90%, 95%, 96%, 97%, 98%, or 99% of a full-length amino acid sequence of an engineered acetate kinase polypeptide of the present invention, such as an exemplary engineered acetate kinase polypeptide selected from the even-numbered sequences in the following range: SEQ ID NO: 4-550.

In some embodiments, the engineered acetate kinase polypeptide can have an amino acid sequence comprising a deletion in any one of the engineered acetate kinase polypeptide sequences described herein, such as the exemplary engineered polypeptides of the even-numbered sequences in the following range: SEQ ID NO: 4-550. Thus, for each and every embodiment of the engineered acetate kinase polypeptides of the invention, the amino acid sequence can comprise deletions of one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 20% of the total number of amino acids, or up to 30% of the total number of amino acids of the acetate kinase polypeptides, where the associated functional activity and/or improved properties of the engineered acetate kinase described herein are maintained. In some embodiments, the deletions can comprise 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residues. In some embodiments, the number of deletions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residues. In some embodiments, the deletions can comprise deletions of 1, 2, 3, 4, 5, 6, 7, 8, 9, 10, 11, 12, 13, 14, 15, 16, 18, 20, 21, 22, 23, 24, or 25 amino acid residues.

In some embodiments, the engineered acetate kinase polypeptide herein can have an amino acid sequence comprising an insertion as compared to any one of the engineered acetate kinase polypeptides described herein, such as the exemplary engineered polypeptides of the even-numbered sequences in the following range: SEQ ID NO: 4-550. Thus, for each and every embodiment of the acetate kinase polypeptides of the invention, the insertions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, 20 or more amino acids, 30 or more amino acids, 40 or more amino acids, or 50 or more amino acids, where the associated functional activity and/or improved properties of the engineered acetate kinase described herein is maintained. The insertions can be to amino or carboxy terminus, or internal portions of the acetate kinase polypeptide.

In some embodiments, the engineered acetate kinase polypeptide herein can have an amino acid sequence comprising a sequence selected from the even-numbered sequences in the following range: SEQ ID NO: 4-550, and optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

In the above embodiments, the suitable reaction conditions for the engineered polypeptides may be as described in the Examples.

In some embodiments, the polypeptides of the present invention are fusion polypeptides in which the engineered polypeptides are fused to other polypeptides, such as, by way of example and not limitation, antibody tags (e.g., myc epitope), purification sequences (e.g., His tags for binding to metals), and cell localization signals (e.g., secretion signals). Thus, the engineered polypeptides described herein can be used with or without fusions to other polypeptides.

It is to be understood that the polypeptides described herein are not restricted to the genetically encoded amino acids. In addition to the genetically encoded amino acids, the polypeptides described herein may be comprised, either in whole or in part, of naturally occurring and/or synthetic non-encoded amino acids. Certain commonly encountered non-encoded amino acids of which the polypeptides described herein may be comprised include, but are not limited to: the D-stereomers of the genetically-encoded amino acids; 2,3-diaminopropionic acid (Dpr); α-aminoisobutyric acid (Aib); ε-aminohexanoic acid (Aha); δ-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutanic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aGly); propargylglycine (pgGly); homoalanine (hAla); norvaline (nVal); homoleucine (hLeu), homovaline (hVal); homoisoleucine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (See e.g., the various amino acids provided in Fasman, *CRC Practical Handbook of Biochemistry and Molecular Biology*, CRC Press, Boca Raton, FL, pp. 3-70 [1989], and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys(methylbenzyl), Cys (nitropyridinesulfenyl), Glu(δ-benzylester), Gln(xanthyl), Asn(N-δ-xanthyl), His(bom), His (benzyl), His(tos), Lys(fmoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the engineered polypeptides can be in various forms, for example, such as an isolated preparation, as a substantially purified enzyme, whole cells transformed with gene(s) encoding the enzyme, and/or as cell extracts and/or lysates of such cells. The enzymes can be lyophilized, spray-dried, precipitated or be in the form of a crude paste, as further discussed below.

In some embodiments, the engineered polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the engineered polypeptides having acetate kinase activity of the present invention can be immobilized on a solid support such that they retain their improved activity, selectivity, and/or other improved properties relative to the reference polypeptide of SEQ ID NO: 2 and/or 4. In such embodiments, the immobilized polypeptides can facilitate the biocatalytic conversion of the substrate compounds or other suitable substrates to the product and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the acetate kinase polypeptides of the present invention can be carried out using the same acetate kinase polypeptides bound or immobilized on a solid support.

Methods of enzyme immobilization are well-known in the art. The engineered polypeptides can be bound non-covalently or covalently. Various methods for conjugation and immobilization of enzymes to solid supports (e.g., resins, membranes, beads, glass, etc.) are well known in the art (See e.g., Yi et al., Proc. Biochem., 42(5): 895-898 [2007]; Martin et al., Appl. Microbiol. Biotechnol., 76(4): 843-851 [2007]; Koszelewski et al., J. Mol. Cat. B: Enzymatic, 63: 39-44 [2010]; Truppo et al., Org. Proc. Res. Dev., published online: dx.doi.org/10.1021/op200157c; Hermanson, *Bioconjugate Techniques*, 2$^{nd}$ ed., Academic Press, Cambridge, MA [2008]; Mateo et al., Biotechnol. Prog., 18(3):629-34 [2002]; and "Bioconjugation Protocols: Strategies and Methods," In *Methods in Molecular Biology*, Niemeyer (ed.), Humana Press, New York, NY [2004]; the disclosures of each which are incorporated by reference herein). Solid supports useful for immobilizing the engineered acetate kinases of the present invention include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered acetate kinase polypeptides of the present invention include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, the polypeptides described herein are provided in the form of kits. The enzymes in the kits may be present individually or as a plurality of enzymes. The kits can further include reagents for carrying out the enzymatic reactions, substrates for assessing the activity of enzymes, as well as reagents for detecting the products. The kits can also include reagent dispensers and instructions for use of the kits.

In some embodiments, the kits of the present invention include arrays comprising a plurality of different acetate kinase polypeptides at different addressable position, wherein the different polypeptides are different variants of a reference sequence each having at least one different improved enzyme property. In some embodiments, a plurality of polypeptides immobilized on solid supports are configured on an array at various locations, addressable for robotic delivery of reagents, or by detection methods and/or instruments. The array can be used to test a variety of substrate compounds for conversion by the polypeptides. Such arrays comprising a plurality of engineered polypeptides and methods of their use are known in the art (See e.g., WO2009/008908A2).

Recombinant polypeptides can be produced using any suitable methods known in the art. Genes encoding the wild-type polypeptide of interest can be cloned in vectors, such as plasmids, and expressed in desired hosts, such as *E. coli*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Mutagenesis and directed evolution methods can be readily applied to enzyme-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, 9,665,694, 9,684,771, and all related US, as well as PCT and non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229: 1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the enzyme clones obtained following mutagenesis treatment are screened by subjecting the enzyme preparations to a defined temperature (or other assay conditions) and measuring the amount of enzyme activity remaining after heat treatments or other suitable assay conditions. Clones containing a polynucleotide encoding a polypeptide are then isolated from the gene, sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

After the variants are produced, they can be screened for any desired property (e.g., high or increased activity, or low or reduced activity, increased thermal activity, increased thermal stability, and/or acidic pH stability, etc.). Any suitable reaction conditions find use in the present invention. In some embodiments, methods are used to analyze the improved properties of the engineered polypeptides to carry out the phosphorylation reaction. In some embodiments, the reaction conditions are modified with regard to concentrations or amounts of engineered AcK, substrate(s), buffer(s), solvent(s), pH, conditions including temperature and reaction time, and/or conditions with the engineered AcK polypeptide immobilized on a solid support, as further described below and in the Examples.

In some embodiments, additional reaction components or additional techniques are utilized to supplement the reaction conditions. In some embodiments, these include taking measures to stabilize or prevent inactivation of the enzyme, reduce product inhibition, and/or shift reaction equilibrium to desired product formation.

In some further embodiments, any of the above described processes for the conversion of substrate compound to product compound can further comprise one or more steps selected from: extraction, isolation, purification, crystallization, filtration, and/or lyophilization of product compound(s). Methods, techniques, and protocols for extracting, isolating, purifying, and/or crystallizing the product(s) from biocatalytic reaction mixtures produced by the processes provided herein are known to the ordinary artisan and/or accessed through routine experimentation. Additionally, illustrative methods are provided in the Examples below.

Engineered AcK Polynucleotides Encoding Engineered Polypeptides, Expression Vectors and Host Cells The present invention provides polynucleotides encoding the engineered enzyme polypeptides described herein. In some embodiments, the polynucleotides are operatively linked to one or more heterologous regulatory sequences that control gene expression to create a recombinant polynucleotide capable of expressing the polypeptide. In some embodiments, expression constructs containing at least one heterologous polynucleotide encoding the engineered enzyme polypeptide(s) is introduced into appropriate host cells to express the corresponding enzyme polypeptide(s).

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode an engineered enzyme (e.g., AcK) polypeptide. Thus, the present invention provides methods and compositions for the production of each and every possible variation of enzyme polynucleotides that could be made that encode the enzyme polypeptides described herein by selecting combinations based on the possible codon choices, and all such variations are to be considered specifically disclosed for any polypeptide described herein, including the amino acid sequences presented in the Examples (e.g., in the various Tables).

In some embodiments, the codons are preferably optimized for utilization by the chosen host cell for protein production. For example, preferred codons used in bacteria are typically used for expression in bacteria. Consequently, codon optimized polynucleotides encoding the engineered enzyme polypeptides contain preferred codons at about 40%, 50%, 60%, 70%, 80%, 90%, or greater than 90% of the codon positions in the full length coding region.

In some embodiments, the enzyme polynucleotide encodes an engineered polypeptide having enzyme activity with the properties disclosed herein, wherein the polypeptide comprises an amino acid sequence having at least 60%, 65%, 70%, 75%, 80%, 85%, 86%, 87%, 88%, 89%, 90%, 91%, 92%, 93%, 94%, 95%, 96%, 97%, 98%, 99% or more identity to a reference sequence selected from the SEQ ID NOS provided herein, or the amino acid sequence of any variant (e.g., those provided in the Examples), and one or more residue differences as compared to the reference polynucleotide(s), or the amino acid sequence of any variant as disclosed in the Examples (for example 1, 2, 3, 4, 5, 6, 7, 8, 9, 10 or more amino acid residue positions). In some embodiments, the reference polypeptide sequence is selected from SEQ ID NOS: 2 and 4.

In some embodiments, the polynucleotides are capable of hybridizing under highly stringent conditions to a reference polynucleotide sequence selected from any polynucleotide sequence provided herein, or a complement thereof, or a polynucleotide sequence encoding any of the variant enzyme polypeptides provided herein. In some embodiments, the polynucleotide capable of hybridizing under highly stringent conditions encodes an enzyme polypeptide comprising an amino acid sequence that has one or more residue differences as compared to a reference sequence.

In some embodiments, an isolated polynucleotide encoding any of the engineered enzyme polypeptides herein is manipulated in a variety of ways to facilitate expression of the enzyme polypeptide. In some embodiments, the polynucleotides encoding the enzyme polypeptides comprise expression vectors where one or more control sequences is present to regulate the expression of the enzyme polynucleotides and/or polypeptides. Manipulation of the isolated polynucleotide prior to its insertion into a vector may be desirable or necessary depending on the expression vector utilized. Techniques for modifying polynucleotides and nucleic acid sequences utilizing recombinant DNA methods are well known in the art. In some embodiments, the control sequences include among others, promoters, leader sequences, polyadenylation sequences, propeptide sequences, signal peptide sequences, and transcription terminators. In some embodiments, suitable promoters are selected based on the host cells selection. For bacterial host cells, suitable promoters for directing transcription of the nucleic acid constructs of the present disclosure, include, but are not limited to promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa- Kamaroff et al., Proc. Natl Acad. Sci. USA 75: 3727-3731 [1978]), as well as the tac promoter (See e.g., DeBoer et al., Proc. Natl Acad. Sci. USA 80: 21-25 [1983]). Exemplary promoters for filamentous fungal host cells, include, but are not limited to promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes for *Saccharomyces cerevisiae* enolase (ENO-1), *Saccharomyces cerevisiae* galactokinase (GAL1), *Saccharomyces cerevisiae* alcohol dehydrogenase/ glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]).

In some embodiments, the control sequence is also a suitable transcription terminator sequence (i.e., a sequence recognized by a host cell to terminate transcription). In some embodiments, the terminator sequence is operably linked to the 3' terminus of the nucleic acid sequence encoding the enzyme polypeptide. Any suitable terminator which is functional in the host cell of choice finds use in the present invention. Exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is also a suitable leader sequence (i.e., a non-translated region of an mRNA that is important for translation by the host cell). In some embodiments, the leader sequence is operably linked to the 5' terminus of the nucleic acid sequence encoding the enzyme polypeptide. Any suitable leader sequence that is functional in the host cell of choice finds use in the present invention. Exemplary leaders for filamentous fungal host cells are obtained from the genes for *Aspergillus oryzae* TAKA amylase, and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence is also a polyadenylation sequence (i.e., a sequence operably linked to the 3' terminus of the nucleic acid sequence and which, when transcribed, is recognized by the host cell as a signal to add polyadenosine residues to transcribed mRNA). Any suitable polyadenylation sequence which is functional in the host cell of choice finds use in the present invention. Exemplary polyadenylation sequences for filamentous fungal host cells include, but are not limited to the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are known (See e.g., Guo and Sherman, Mol. Cell. Bio., 15:5983-5990 [1995]).

In some embodiments, the control sequence is also a signal peptide (i.e., a coding region that codes for an amino acid sequence linked to the amino terminus of a polypeptide and directs the encoded polypeptide into the cell's secretory pathway). In some embodiments, the 5' end of the coding sequence of the nucleic acid sequence inherently contains a signal peptide coding region naturally linked in translation reading frame with the segment of the coding region that encodes the secreted polypeptide. Alternatively, in some embodiments, the 5' end of the coding sequence contains a signal peptide coding region that is foreign to the coding sequence. Any suitable signal peptide coding region which directs the expressed polypeptide into the secretory pathway of a host cell of choice finds use for expression of the engineered polypeptide(s). Effective signal peptide coding regions for bacterial host cells are the signal peptide coding regions that include, but are not limited to those obtained from the genes for *Bacillus* NC1B 11837 maltogenic amylase, *Bacillus stearothennophilus* alpha-amylase, *Bacillus licheniformis* subtilisin, *Bacillus licheniformis* beta-lactamase, *Bacillus stearothennophilus* neutral proteases (nprT, nprS, nprM), and *Bacillus subtilis* prsA. Further signal peptides are known in the art (See e.g., Simonen and Palva, Microbiol. Rev., 57:109-137 [1993]). In some embodiments, effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is also a propeptide coding region that codes for an amino acid sequence positioned at the amino terminus of a polypeptide. The resultant polypeptide is referred to as a "proenzyme," "propolypeptide," or "zymogen." A propolypeptide can be converted to a mature active polypeptide by catalytic or autocatalytic cleavage of the propeptide from the propolypeptide. The propeptide coding region may be obtained from any suitable source, including, but not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those that cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention is directed to a recombinant expression vector comprising a polynucleotide encoding an engineered enzyme polypeptide, and one or more expression regulating regions such as a promoter and a terminator, a replication origin, etc., depending on the type of hosts into which they are to be introduced. In some embodiments, the various nucleic acid and control sequences described herein are joined together to produce recombinant expression vectors which include one or more convenient restriction sites to allow for insertion or substitution of the nucleic acid sequence encoding the enzyme polypeptide at such sites. Alternatively, in some embodiments, the nucleic acid sequence of the present invention is expressed by inserting the nucleic acid sequence or a nucleic acid construct comprising the sequence into an appropriate vector for expression. In some embodiments involving the creation of the expression vector, the coding sequence is located in the vector so that the coding sequence is operably linked with the appropriate control sequences for expression.

The recombinant expression vector may be any suitable vector (e.g., a plasmid or virus), that can be conveniently subjected to recombinant DNA procedures and bring about the expression of the enzyme polynucleotide sequence. The choice of the vector typically depends on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector is one in which, when introduced into the host cell, it is integrated into the genome and replicated together with the chromosome(s) into which it has been integrated. Furthermore, in some embodiments, a single vector or plasmid, or two or more vectors or plasmids which together contain the total DNA to be introduced into the genome of the host cell, and/or a transposon is utilized.

In some embodiments, the expression vector contains one or more selectable markers, which permit easy selection of transformed cells. A "selectable marker" is a gene, the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in filamentous fungal host cells include, but are not limited to, amdS (acetamidase; e.g., from *A. nidulans* or *A. orzyae*), argB (ornithine carbamoyltransferases), bar (phosphinothricin acetyltransferase; e.g., from *S. hygroscopicus*), hph (hygromycin phosphotransferase), niaD (nitrate reductase), pyrG (orotidine-5'-phosphate decarboxylase; e.g., from *A. nidulans* or *A. orzyae*), sC (sulfate adenyltransferase), and trpC (anthranilate synthase), as well as equivalents thereof.

In another aspect, the present invention provides a host cell comprising at least one polynucleotide encoding at least one engineered enzyme polypeptide of the present invention, the polynucleotide(s) being operatively linked to one or more control sequences for expression of the engineered enzyme enzyme(s) in the host cell. Host cells suitable for use in expressing the polypeptides encoded by the expression vectors of the present invention are well known in the art and include but are not limited to, bacterial cells, such as *E. coli*, *Vibrio fluvialis*, *Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Exemplary host cells also include various *Escherichia coli* strains (e.g., W3110 (ΔfhuA) and BL21). Examples of bacterial selectable markers include, but are not limited to the dal genes from *Bacillus subtilis* or *Bacillus licheniformis*, or markers, which confer antibiotic resistance such as ampicillin, kanamycin, chloramphenicol, and/or tetracycline resistance.

In some embodiments, the expression vectors of the present invention contain an element(s) that permits integration of the vector into the host cell's genome or autonomous replication of the vector in the cell independent of the genome. In some embodiments involving integration into the host cell genome, the vectors rely on the nucleic acid sequence encoding the polypeptide or any other element of the vector for integration of the vector into the genome by homologous or nonhomologous recombination.

In some alternative embodiments, the expression vectors contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements preferably contain a sufficient number of nucleotides, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A ori or the origins of replication of plasmids pBR322, pUC19, pACYC177 (which plasmid has the P15A ori), or pACYC184 permitting replication in *E. coli*, and pUB110, pE194, or pTA1060 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes its functioning temperature-sensitive in the host cell (See e.g., Ehrlich, Proc. Natl. Acad. Sci. USA 75:1433 [1978]).

In some embodiments, more than one copy of a nucleic acid sequence of the present invention is inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many of the expression vectors for use in the present invention are commercially available. Suitable commercial expression vectors include, but are not limited to the p3×FLAGTM™ expression vectors (Sigma-Aldrich Chemicals), which include a CMV promoter and hGH polyadenylation site for expression in mammalian host cells and a pBR322 origin of replication and ampicillin resistance markers for amplification in *E. coli*. Other suitable expression vectors include, but are not limited to pBluescriptII SK(-) and pBK-CMV (Stratagene), and plasmids derived from pBR322 (Gibco BRL), pUC (Gibco BRL), pREP4, pCEP4 (Invitrogen) or pPoly (See e.g., Lathe et al., Gene 57:193-201 [1987]).

Thus, in some embodiments, a vector comprising a sequence encoding at least one variant acetate kinase is transformed into a host cell in order to allow propagation of the vector and expression of the variant acetate kinase(s). In some embodiments, the variant acetate kinases are post-translationally modified to remove the signal peptide and, in some cases, may be cleaved after secretion. In some embodiments, the transformed host cell described above is cultured in a suitable nutrient medium under conditions permitting the expression of the variant acetate kinase(s). Any suitable medium useful for culturing the host cells finds use in the present invention, including, but not limited to minimal or complex media containing appropriate supplements. In some embodiments, host cells are grown in HTP media. Suitable media are available from various commercial suppliers or may be prepared according to published recipes (e.g., in catalogues of the American Type Culture Collection).

In another aspect, the present invention provides host cells comprising a polynucleotide encoding an improved acetate kinase polypeptide provided herein, the polynucleotide being operatively linked to one or more control sequences for expression of the acetate kinase enzyme in the host cell. Host cells for use in expressing the acetate kinase polypeptides encoded by the expression vectors of the present invention are well known in the art and include but are not limited to, bacterial cells, such as *E. coli*, *Bacillus megaterium*, *Lactobacillus kefir*, *Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Appropriate culture media and growth conditions for the above-described host cells are well known in the art.

Polynucleotides for expression of the acetate kinase may be introduced into cells by various methods known in the art. Techniques include among others, electroporation, biolistic particle bombardment, liposome mediated transfection, calcium chloride transfection, and protoplast fusion. Various methods for introducing polynucleotides into cells are known to those skilled in the art.

In some embodiments, the host cell is a eukaryotic cell. Suitable eukaryotic host cells include, but are not limited to, fungal cells, algal cells, insect cells, and plant cells. Suitable fungal host cells include, but are not limited to, Ascomycota, Basidiomycota, Deuteromycota, Zygomycota, Fungi imperfecti. In some embodiments, the fungal host cells are yeast cells and filamentous fungal cells. The filamentous fungal host cells of the present invention include all filamentous forms of the subdivision Eumycotina and Oomycota. Filamentous fungi are characterized by a vegetative mycelium with a cell wall composed of chitin, cellulose and other complex polysaccharides. The filamentous fungal host cells of the present invention are morphologically distinct from yeast.

In some embodiments of the present invention, the filamentous fungal host cells are of any suitable genus and species, including, but not limited to *Achlya*, *Acremonium*, *Aspergillus*, *Aureobasidium*, *Bjerkandera*, *Ceriporiopsis*, *Cephalosporium*, *Chrysosporium*, *Cochliobolus*, *Corynascus*, *Cryphonectria*, *Cryptococcus*, *Coprinus*, *Coriolus*, *Diplodia*, *Endothia*, *Fusarium*, *Gibberella*, *Gliocladium*, *Humicola*, *Hypocrea*, *Myceliophthora*, *Mucor*, *Neurospora*, *Penicillium*, *Podospora*, *Phlebia*, *Piromyces*, *Pyricularia*, *Rhizomucor*, *Rhizopus*, *Schizophyllum*, *Scytalidium*, *Sporotrichum*, *Talaromyces*, *Thermoascus*, *Thielavia*, *Trametes*, *Tolypocladium*, *Trichoderma*, *Verticillium*, and/or *Volvariella*, and/or teleomorphs, or anamorphs, and synonyms, basionyms, or taxonomic equivalents thereof.

In some embodiments of the present invention, the host cell is a yeast cell, including but not limited to cells of *Candida*, *Hansenula*, *Saccharomyces*, *Schizosaccharomyces*, *Pichia*, *Kluyveromyces*, or *Yarrowia* species. In some embodiments of the present invention, the yeast cell is *Hansenula polymorpha*, *Saccharomyces cerevisiae*, *Saccharomyces carlsbergensis*, *Saccharomyces diastaticus*, *Saccharomyces norbensis*, *Saccharomyces kluyveri*, *Schizosaccharomyces pombe*, *Pichia pastoris*, *Pichia finlandica*, *Pichia trehalophila*, *Pichia kodamae*, *Pichia membranaefaciens*, *Pichia opuntiae*, *Pichia thermotolerans*, *Pichia salictaria*, *Pichia quercuum*, *Pichia pijperi*, *Pichia stipitis*, *Pichia methanolica*, *Pichia angusta*, *Kluyveromyces lactis*, *Candida albicans*, or *Yarrowia lipolytica*.

In some embodiments of the invention, the host cell is an algal cell such as *Chlamydomonas* (e.g., *C. reinhardtii*) and *Phormidium* (*P.* sp. ATCC29409).

In some other embodiments, the host cell is a prokaryotic cell. Suitable prokaryotic cells include, but are not limited to Gram-positive, Gram-negative and Gram-variable bacterial cells. Any suitable bacterial organism finds use in the present invention, including but not limited to *Agrobacterium*, *Alicyclobacillus*, *Anabaena*, *Anacystis*, *Acinetobacter*, *Acidothermus*, *Arthrobacter*, *Azobacter*, *Bacillus*, *Bifidobacterium*, *Brevibacterium*, *Butyrivibrio*, *Buchnera*, *Campestris*, *Campylobacter*, *Clostridium*, *Corynebacterium*, *Chromatium*, *Coprococcus*, *Escherichia*, *Enterococcus*, *Enterobacter*, *Erwinia*, *Fusobacterium*, *Faecalibacterium*, *Francisella*, *Flavobacterium*, *Geobacillus*, *Haemophilus*, *Helicobacter*, *Klebsiella*, *Lactobacillus*, *Lactococcus*, *Ilyobacter*, *Micrococcus*, *Microbacterium*, *Mesorhizobium*, *Methylobacterium*, *Methylobacterium*, *Mycobacterium*, *Neisseria*, *Pantoea*, *Pseudomonas*, *Prochlorococcus*, *Rhodobacter*, *Rhodopseudomonas*, *Rhodopseudomonas*, *Roseburia*, *Rhodospirillum*, *Rhodococcus*, *Scenedesmus*, *Streptomyces*, *Streptococcus*, *Synecoccus*, *Saccharomonospora*, *Staphylococcus*, *Serratia*, *Salmonella*, *Shigella*, *Thermoanaerobacterium*, *Tropheryma*, *Tularensis*, *Temecula*, *Thermosynechococcus*, *Thermococcus*, *Ureaplasma*, *Xanthomo-* nas, *Xylella, Yersinia* and *Zymomonas*. In some embodiments, the host cell is a species of *Agrobacterium, Acinetobacter, Azobacter, Bacillus, Bifidobacterium, Buchnera, Geobacillus, Campylobacter, Clostridium, Corynebacterium, Escherichia, Enterococcus, Erwinia, Flavobacterium, Lactobacillus, Lactococcus, Pantoea, Pseudomonas, Staphylococcus, Salmonella, Streptococcus, Streptomyces,* or *Zymomonas*. In some embodiments, the bacterial host strain is non-pathogenic to humans. In some embodiments the bacterial host strain is an industrial strain. Numerous bacterial industrial strains are known and suitable in the present invention. In some embodiments of the present invention, the bacterial host cell is an Agrobacterium species (e.g., *A. radiobacter, A. rhizogenes,* and *A. rubi*). In some embodiments of the present invention, the bacterial host cell is an *Arthrobacter* species (e.g., *A. aurescens, A. citreus, A. globiformis, A. hydrocarboglutamicus, A. mysorens, A. nicotianae, A. paraffineus, A. protophonniae, A. roseoparqffinus, A. sulfureus,* and *A. ureafaciens*). In some embodiments of the present invention, the bacterial host cell is a *Bacillus* species (e.g., *B. thuringensis, B. anthracis, B. megaterium, B. subtilis, B. lentus, B. circulans, B. pumilus, B. lautus, B. coagulans, B. brevis, B. firmus, B. alkaophius, B. licheniformis, B. clausii, B. stearothermophilus, B. halodurans,* and *B. amyloliquefaciens*). In some embodiments, the host cell is an industrial *Bacillus* strain including but not limited to *B. subtilis, B. pumilus, B. licheniformis, B. megaterium, B. clausii, B. stearothermophilus,* or *B. amyloliquefaciens*. In some embodiments, the *Bacillus* host cells are *B. subtilis, B. licheniformis, B. megaterium, B. stearothermophilus,* and/or *B. amyloliquefaciens*. In some embodiments, the bacterial host cell is a *Clostridium* species (e.g., *C. acetobutylicum, C. tetani* E88, *C. lituseburense, C. saccharobutylicum, C. perfringens,* and *C. beijerinckii*). In some embodiments, the bacterial host cell is a *Corynebacterium* species (e.g., *C. glutamicum* and *C. acetoacidophilum*). In some embodiments the bacterial host cell is an *Escherichia* species (e.g., *E. coli*). In some embodiments, the host cell is *Escherichia coli* W3110. In some embodiments, the bacterial host cell is an *Erwinia* species (e.g., *E. uredovora, E. carotovora, E. ananas, E. herbicola, E. punctata,* and *E. terreus*). In some embodiments, the bacterial host cell is a *Pantoea* species (e.g., *P. citrea,* and *P. agglomerans*). In some embodiments the bacterial host cell is a *Pseudomonas* species (e.g., *P. putida, P. aeruginosa, P. mevalonii,* and *P.* sp. D-01 10). In some embodiments, the bacterial host cell is a *Streptococcus* species (e.g., *S. equisimiles, S. pyogenes,* and *S. uberis*). In some embodiments, the bacterial host cell is a *Streptomyces* species (e.g., *S. ambofaciens, S. achromogenes, S. avermitilis, S. coelicolor, S. aureofaciens, S. aureus, S. fungicidicus, S. griseus,* and *S. lividans*). In some embodiments, the bacterial host cell is a *Zymomonas* species (e.g., *Z. mobilis,* and *Z. lipolytica*).

Many prokaryotic and eukaryotic strains that find use in the present invention are readily available to the public from a number of culture collections such as American Type Culture Collection (ATCC), Deutsche Sammlung von Mikroorganismen and Zellkulturen GmbH (DSM), Centraalbureau Voor Schimmelcultures (CBS), and Agricultural Research Service Patent Culture Collection, Northern Regional Research Center (NRRL).

In some embodiments, host cells are genetically modified to have characteristics that improve protein secretion, protein stability and/or other properties desirable for expression and/or secretion of a protein. Genetic modification can be achieved by genetic engineering techniques and/or classical microbiological techniques (e.g., chemical or UV mutagenesis and subsequent selection). Indeed, in some embodiments, combinations of recombinant modification and classical selection techniques are used to produce the host cells. Using recombinant technology, nucleic acid molecules can be introduced, deleted, inhibited or modified, in a manner that results in increased yields of acetate kinase variant(s) within the host cell and/or in the culture medium. For example, knockout of Alp1 function results in a cell that is protease deficient, and knockout of pyr5 function results in a cell with a pyrimidine deficient phenotype. In one genetic engineering approach, homologous recombination is used to induce targeted gene modifications by specifically targeting a gene in vivo to suppress expression of the encoded protein. In alternative approaches, siRNA, antisense and/or ribozyme technology find use in inhibiting gene expression. A variety of methods are known in the art for reducing expression of protein in cells, including, but not limited to deletion of all or part of the gene encoding the protein and site-specific mutagenesis to disrupt expression or activity of the gene product. (See e.g., Chaveroche et al., Nucl. Acids Res., 28:22 e97 [2000]; Cho et al., Molec. Plant Microbe Interact., 19:7-15 [2006]; Maruyama and Kitamoto, Biotechnol Lett., 30:1811-1817 [2008]; Takahashi et al., Mol. Gen. Genom., 272: 344-352 [2004]; and You et al., Arch. Microbiol.,191:615-622 [2009], all of which are incorporated by reference herein). Random mutagenesis, followed by screening for desired mutations also finds use (See e.g., Combier et al., FEMS Microbiol. Lett., 220:141-8 [2003]; and Firon et al., Eukary. Cell 2:247-55 [2003], both of which are incorporated by reference).

Introduction of a vector or DNA construct into a host cell can be accomplished using any suitable method known in the art, including but not limited to calcium phosphate transfection, DEAE-dextran mediated transfection, PEG-mediated transformation, electroporation, or other common techniques known in the art. In some embodiments, the *Escherichia coli* expression vector pCK100900i (See, U.S. Pat. No. 9,714,437, which is hereby incorporated by reference) finds use.

In some embodiments, the engineered host cells (i.e., "recombinant host cells") of the present invention are cultured in conventional nutrient media modified as appropriate for activating promoters, selecting transformants, or amplifying the acetate kinase polynucleotide. Culture conditions, such as temperature, pH and the like, are those previously used with the host cell selected for expression, and are well-known to those skilled in the art. As noted, many standard references and texts are available for the culture and production of many cells, including cells of bacterial, plant, animal (especially mammalian) and archebacterial origin.

In some embodiments, cells expressing the variant acetate kinase polypeptides of the invention are grown under batch or continuous fermentations conditions. Classical "batch fermentation" is a closed system, wherein the compositions of the medium is set at the beginning of the fermentation and is not subject to artificial alternations during the fermentation. A variation of the batch system is a "fed-batch fermentation" which also finds use in the present invention. In this variation, the substrate is added in increments as the fermentation progresses. Fed-batch systems are useful when catabolite repression is likely to inhibit the metabolism of the cells and where it is desirable to have limited amounts of substrate in the medium. Batch and fed-batch fermentations are common and well known in the art. "Continuous fermentation" is an open system where a defined fermentation medium is added continuously to a bioreactor and an equal amount of conditioned medium is removed simultaneously for processing. Continuous fermentation generally maintains the cultures at a constant high density where cells are primarily in log phase growth. Continuous fermentation systems strive to maintain steady state growth conditions. Methods for modulating nutrients and growth factors for continuous fermentation processes as well as techniques for maximizing the rate of product formation are well known in the art of industrial microbiology.

In some embodiments of the present invention, cell-free transcription/translation systems find use in producing variant acetate kinase(s). Several systems are commercially available, and the methods are well-known to those skilled in the art.

The present invention provides methods of making variant acetate kinase polypeptides or biologically active fragments thereof. In some embodiments, the method comprises: providing a host cell transformed with a polynucleotide encoding an amino acid sequence that comprises at least about 70% (or at least about 75%, at least about 80%, at least about 85%, at least about 90%, at least about 95%, at least about 96%, at least about 97%, at least about 98%, or at least about 99%) sequence identity to SEQ ID NO: 2 and/or 4, and comprising at least one mutation as provided herein; culturing the transformed host cell in a culture medium under conditions in which the host cell expresses the encoded variant acetate kinase polypeptide; and optionally recovering or isolating the expressed variant acetate kinase polypeptide, and/or recovering or isolating the culture medium containing the expressed variant acetate kinase polypeptide. In some embodiments, the methods further provide optionally lysing the transformed host cells after expressing the encoded acetate kinase polypeptide and optionally recovering and/or isolating the expressed variant acetate kinase polypeptide from the cell lysate. The present invention further provides methods of making a variant acetate kinase polypeptide comprising cultivating a host cell transformed with a variant acetate kinase polynucleotide under conditions suitable for the production of the variant acetate kinase polypeptide and recovering the acetate kinase polypeptide. Typically, recovery or isolation of the acetate kinase polypeptide is from the host cell culture medium, the host cell or both, using protein recovery techniques that are well known in the art, including those described herein. In some embodiments, host cells are harvested by centrifugation, disrupted by physical or chemical means, and the resulting crude extract retained for further purification. Microbial cells employed in expression of proteins can be disrupted by any convenient method, including, but not limited to freeze-thaw cycling, sonication, mechanical disruption, and/or use of cell lysing agents, as well as many other suitable methods well known to those skilled in the art.

Engineered acetate kinase enzymes expressed in a host cell can be recovered from the cells and/or the culture medium using any one or more of the techniques known in the art for protein purification, including, among others, lysozyme treatment, sonication, filtration, salting-out, ultracentrifugation, and chromatography. Suitable solutions for lysing and the high efficiency extraction of proteins from bacteria, such as E. coli, are commercially available under the trade name CelLytic B™ (Sigma-Aldrich). Thus, in some embodiments, the resulting polypeptide is recovered/isolated and optionally purified by any of a number of methods known in the art. For example, in some embodiments, the polypeptide is isolated from the nutrient medium by conventional procedures including, but not limited to, centrifugation, filtration, extraction, spray-drying, evaporation, chromatography (e.g., ion exchange, affinity, hydrophobic interaction, chromatofocusing, and size exclusion), or precipitation. In some embodiments, protein refolding steps are used, as desired, in completing the configuration of the mature protein. In addition, in some embodiments, high performance liquid chromatography (HPLC) is employed in the final purification steps. For example, in some embodiments, methods known in the art, find use in the present invention (See e.g., Parry et al., Biochem. J., 353:117 [2001]; and Hong et al., Appl. Microbiol. Biotechnol., 73:1331 [2007], both of which are incorporated herein by reference). Indeed, any suitable purification methods known in the art find use in the present invention.

Chromatographic techniques for isolation of the acetate kinase polypeptide include, but are not limited to reverse phase chromatography, high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., are known to those skilled in the art.

In some embodiments, affinity techniques find use in isolating the improved acetate kinase enzymes. For affinity chromatography purification, any antibody which specifically binds the acetate kinase polypeptide may be used. For the production of antibodies, various host animals, including but not limited to rabbits, mice, rats, etc., may be immunized by injection with the acetate kinase. The acetate kinase polypeptide may be attached to a suitable carrier, such as BSA, by means of a side chain functional group or linkers attached to a side chain functional group. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (Bacillus Calmette Guerin) and Corynebacterium parvum.

In some embodiments, the acetate kinase variants are prepared and used in the form of cells expressing the enzymes, as crude extracts, or as isolated or purified preparations. In some embodiments, the acetate kinase variants are prepared as lyophilisates, in powder form (e.g., acetone powders), or prepared as enzyme solutions. In some embodiments, the acetate kinase variants are in the form of substantially pure preparations.

In some embodiments, the acetate kinase polypeptides are attached to any suitable solid substrate. Solid substrates include but are not limited to a solid phase, surface, and/or membrane. Solid supports include, but are not limited to organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of the substrate can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location. A plurality of supports can be configured on an array at various locations, addressable for robotic delivery of reagents, or by detection methods and/or instruments.

In some embodiments, immunological methods are used to purify acetate kinase variants. In one approach, antibody raised against a wild-type or variant acetate kinase polypeptide (e.g., against a polypeptide comprising any of SEQ ID NO: 2 and/or 4, and/or a variant thereof, and/or an immunogenic fragment thereof) using conventional methods is immobilized on beads, mixed with cell culture media under conditions in which the variant acetate kinase is bound, and precipitated. In a related approach, immunochromatography finds use.

In some embodiments, the variant acetate kinases are expressed as a fusion protein including a non-enzyme portion. In some embodiments, the variant acetate kinase sequence is fused to a purification facilitating domain. As used herein, the term "purification facilitating domain" refers to a domain that mediates purification of the polypeptide to which it is fused. Suitable purification domains include, but are not limited to metal chelating peptides, histidine-tryptophan modules that allow purification on immobilized metals, a sequence which binds glutathione (e.g., GST), a hemagglutinin (HA) tag (corresponding to an epitope derived from the influenza hemagglutinin protein; See e.g., Wilson et al., Cell 37:767 [1984]), maltose binding protein sequences, the FLAG epitope utilized in the FLAGS extension/affinity purification system (e.g., the system available from Immunex Corp), and the like. One expression vector contemplated for use in the compositions and methods described herein provides for expression of a fusion protein comprising a polypeptide of the invention fused to a polyhistidine region separated by an enterokinase cleavage site. The histidine residues facilitate purification on IMIAC (immobilized metal ion affinity chromatography; See e.g., Porath et al., Prot. Exp. Purif., 3:263-281 [1992]) while the enterokinase cleavage site provides a means for separating the variant acetate kinase polypeptide from the fusion protein. pGEX vectors (Promega) may also be used to express foreign polypeptides as fusion proteins with glutathione S-transferase (GST). In general, such fusion proteins are soluble and can easily be purified from lysed cells by adsorption to ligand-agarose beads (e.g., glutathione-agarose in the case of GST-fusions) followed by elution in the presence of free ligand.

Accordingly, in another aspect, the present invention provides methods of producing the engineered enzyme polypeptides, where the methods comprise culturing a host cell capable of expressing a polynucleotide encoding the engineered enzyme polypeptide under conditions suitable for expression of the polypeptide. In some embodiments, the methods further comprise the steps of isolating and/or purifying the enzyme polypeptides, as described herein.

Appropriate culture media and growth conditions for host cells are well known in the art. It is contemplated that any suitable method for introducing polynucleotides for expression of the enzyme polypeptides into cells will find use in the present invention. Suitable techniques include, but are not limited to electroporation, biolistic particle bombardment, liposome mediated transfection, calcium chloride transfection, and protoplast fusion.

Methods of Using the Engineered Acetate Kinase Enzymes

In some embodiments, the acetate kinases described herein find use in processes for converting a suitable nucleoside diphosphate substrate, such as F-thioADP (5) or F-thioGDP (7), to its corresponding nucleoside triphosphate product, such as F-thioATP (3) or F-thioGTP (2). Generally, the process for performing the phosphorylation reaction comprises contacting or incubating the substrate compound in presence of a co-substrate, such as acetyl phosphate, with an acetate kinase polypeptide of the invention under reaction conditions suitable for formation of the triphosphate product, as shown in Scheme 3 and Scheme 4, above.

In the embodiments provided herein and illustrated in the Examples, various ranges of suitable reaction conditions that can be used in the processes, include but are not limited to, substrate loading, co-substrate loading, reductant, divalent transition metal, pH, temperature, buffer, solvent system, polypeptide loading, and reaction time. Further suitable reaction conditions for carrying out the process for biocatalytic conversion of substrate compounds to product compounds using an engineered acetate kinase polypeptide described herein can be readily optimized in view of the guidance provided herein by routine experimentation that includes, but is not limited to, contacting the engineered acetate kinase polypeptide and substrate compound under experimental reaction conditions of concentration, pH, temperature, and solvent conditions, and detecting the product compound.

Suitable reaction conditions using the engineered acetate kinase polypeptides typically comprise a co-substrate, which is used stoichiometrically in the phosphorylation reaction. Generally, the co-substrate for acetate kinases is acetyl phosphate. Other phosphoryl group donors that are capable of serving as co-substrates for acetate kinases can be used. Because the co-substrate is used stoichiometrically, the co-substrate is present at an equimolar or higher amount than that of the substrate compound (i.e., the molar concentration of co-substrate is equivalent to or higher than the molar concentration of substrate compound). In some embodiments, the suitable reaction conditions can comprise a co-substrate molar concentration of at least 1 fold, 1.5 fold, 2 fold, 3 fold 4 fold or 5 fold or more than the molar concentration of the substrate compound. In some embodiments, the suitable reaction conditions can comprise a co-substrate concentration, particularly acetyl phosphate of about 0.0005 M to about 2 M, 0.01 M to about 2 M, 0.1 M to about 2 M, 0.2 M to about 2 M, about 0.5 M to about 2 M, or about 1 M to about 2 M. In some embodiments, the reaction conditions comprise a co-substrate concentration of about 0.0001 M, 0.001 M, 0.01 M, 0.1 M, 0.2 M, 0.3 M, 0.4 M, 0.5 M, 0.6 M, 0.7 M, 0.8 M, 1 M, 1.5 M, or 2 M. In some embodiments, additional co-substrate can be added during the reaction.

Substrate compound in the reaction mixtures can be varied, taking into consideration, for example, the desired amount of product compound, the effect of substrate concentration on enzyme activity, stability of enzyme under reaction conditions, and the percent conversion of substrate to product. In some embodiments, the suitable reaction conditions comprise a substrate compound loading of at least about 0.5 to about 200 g/L, 1 to about 200 g/L, 5 to about 150 g/L, about 10 to about 100 g/L, 20 to about 100 g/L or about 50 to about 100 g/L. In some embodiments, the suitable reaction conditions comprise a substrate compound loading of at least about 0.5 g/L, at least about 1 g/L, at least about 5 g/L, at least about 10 g/L, at least about 15 g/L, at least about 20 g/L, at least about 30 g/L, at least about 50 g/L, at least about 75 g/L, at least about 100 g/L, at least about 150 g/L or at least about 200 g/L, or even greater. The values for substrate loadings provided herein are based on the molecular weight of F-thioADP (5) or F-thioGDP (7); however, it also contemplated that the equivalent molar amounts of various nucleoside diphosphate analogues also can be used in the process.

In carrying out the acetate kinase mediated processes described herein, the engineered polypeptide may be added to the reaction mixture in the form of a purified enzyme, partially purified enzyme, whole cells transformed with gene(s) encoding the enzyme, as cell extracts and/or lysates of such cells, and/or as an enzyme immobilized on a solid support. Whole cells transformed with gene(s) encoding the engineered acetate kinase enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (ammonium sulfate, polyethyleneimine, heat treatment or the like, followed by a desalting procedure prior to lyophilization (e.g., ultrafiltration, dialysis, etc.). Any of the enzyme preparations (including whole cell preparations) may be stabilized by crosslinking using known crosslinking agents, such as, for example, glutaraldehyde or immobilization to a solid phase (e.g., Eupergit C, and the like).

The gene(s) encoding the engineered acetate kinase polypeptides can be transformed into host cells separately or together into the same host cell. For example, in some embodiments one set of host cells can be transformed with gene(s) encoding one engineered acetate kinase polypeptide and another set can be transformed with gene(s) encoding another engineered acetate kinase polypeptide. Both sets of transformed cells can be utilized together in the reaction mixture in the form of whole cells, or in the form of lysates or extracts derived therefrom. In other embodiments, a host cell can be transformed with gene(s) encoding multiple engineered acetate kinase polypeptide. In some embodiments the engineered polypeptides can be expressed in the form of secreted polypeptides, and the culture medium containing the secreted polypeptides can be used for the acetate kinase reaction.

In some embodiments, the improved activity and/or selectivity of the engineered acetate kinase polypeptides disclosed herein provides for processes wherein higher percentage conversion can be achieved with lower concentrations of the engineered polypeptide. In some embodiments of the process, the suitable reaction conditions comprise an engineered polypeptide amount of about 0.03% (w/w), 0.05% (w/w), 0.1% (w/w), 0.15% (w/w), 0.2% (w/w), 0.3% (w/w), 0.4% (w/w), 0.5% (w/w), 1% (w/w), 2% (w/w), 5% (w/w), 10% (w/w), 20% (w/w) or more of substrate compound loading.

In some embodiments, the engineered polypeptide is present at about 0.01 g/L to about 15 g/L; about 0.05 g/L to about 15 g/L; about 0.1 g/L to about 10 g/L; about 1 g/L to about 8 g/L; about 0.5 g/L to about 10 g/L; about 1 g/L to about 10 g/L; about 0.1 g/L to about 5 g/L; about 0.5 g/L to about 5 g/L; or about 0.1 g/L to about 2 g/L. In some embodiments, the acetate kinase polypeptide is present at about 0.01 g/L, 0.05 g/L, 0.1 g/L, 0.2 g/L, 0.5 g/L, 1 g/L, 2 g/L, 5 g/L, 10 g/L, or 15 g/L.

In some embodiments, the reaction conditions also comprise a divalent metal capable of serving as a cofactor in the reaction. Generally, the divalent metal co-factor is magnesium (i.e., $Mg^{+2}$). The magnesium ion may be provided in various forms, such as magnesium chloride ($MgCl_2$). While magnesium ion is the metal co-factor found in the naturally occurring acetate kinase and functions efficiently in the engineered enzymes, it is to be understood that other divalent metals capable of acting as a co-factor can be used in the processes. In some embodiments, the reaction conditions can comprises a divalent metal cofactor, particularly $Mg^{+2}$, at a concentration of about 1 mM to 1 M, 1 mM to 100 mM, 1 mM to about 50 mM, 25 mM to about 35 mM, about 30 mM to about 60 mM or about 55 mM to about 65 mM. In some embodiments, the reaction conditions comprise a divalent metal co-factor concentration of about 1 mM, 10 mM, 20 mM, 30 mM, 40 mM, 50 mM, 60 mM, 70 mM, 80 mM, 90 mM, or 100 mM.

During the course of the reaction, the pH of the reaction mixture may change. The pH of the reaction mixture may be maintained at a desired pH or within a desired pH range. This may be done by the addition of an acid or a base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, phosphate, 2-(N-morpholino)ethanesulfonic acid (MES), 3-(N-morpholino)propanesulfonic acid (MOPS), acetate, triethanolamine, and 2-amino-2-hydroxymethyl-propane-1,3-diol (Tris), and the like. In some embodiments, the buffer is tris. In some embodiments of the process, the suitable reaction conditions comprise a buffer (e.g., tris) concentration of from about 0.01 to about 0.4 M, 0.05 to about 0.4 M, 0.1 to about 0.3 M, or about 0.1 to about 0.2 M. In some embodiments, the reaction condition comprises a buffer (e.g., tris) concentration of about 0.01, 0.02, 0.03, 0.04, 0.05, 0.07, 0.1, 0.12, 0.14, 0.16, 0.18, 0.2, 0.3, or 0.4 M.

In the embodiments of the process, the reaction conditions can comprise a suitable pH. The desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH from about 4 to about 10, pH from about 5 to about 10, pH from about 5 to about 9, pH from about 6 to about 9, pH from about 6 to about 8. In some embodiments, the reaction conditions comprise a solution pH of about 4, 4.5, 5, 5.5, 6, 6.5, 7, 7.5, 8, 8.5, 9, 9.5, or 10.

In the embodiments of the processes herein, a suitable temperature can be used for the reaction conditions, for example, taking into consideration the increase in reaction rate at higher temperatures, and the activity of the enzyme during the reaction time period. Accordingly, in some embodiments, the suitable reaction conditions comprise a temperature of about 10° C. to about 60° C., about 10° C. to about 55° C., about 15° C. to about 60° C., about 20° C. to about 60° C., about 20° C. to about 55° C., about 25° C. to about 55° C., or about 30° C. to about 50° C. In some embodiments, the suitable reaction conditions comprise a temperature of about 10° C., 15° C., 20° C., 25° C., 30° C., 35° C., 40° C., 45° C., 50° C., 55° C., or 60° C. In some embodiments, the temperature during the enzymatic reaction can be maintained at a specific temperature throughout the course of the reaction. In some embodiments, the temperature during the enzymatic reaction can be adjusted over a temperature profile during the course of the reaction.

In some embodiments, the reaction conditions can comprise a surfactant for stabilizing or enhancing the reaction. Surfactants can comprise non-ionic, cationic, anionic and/or amphiphilic surfactants. Exemplary surfactants, include by way of example and not limitation, nonyl phenoxypolyethoxylethanol (NP40), Triton X-100, polyoxyethylene-stearylamine, cetyltrimethylammonium bromide, sodium oleylamidosulfate, polyoxyethylene-sorbitanmonostearate, hexadecyldimethylamine, etc. Any surfactant that may stabilize or enhance the reaction may be employed. The concentration of the surfactant to be employed in the reaction may be generally from 0.1 to 50 mg/ml, particularly from 1 to 20 mg/ml.

In some embodiments, the reaction conditions can include an antifoam agent, which aids in reducing or preventing formation of foam in the reaction solution, such as when the reaction solutions are mixed or sparged. Anti-foam agents include non-polar oils (e.g., minerals, silicones, etc.), polar oils (e.g., fatty acids, alkyl amines, alkyl amides, alkyl sulfates, etc.), and hydrophobic (e.g., treated silica, polypropylene, etc.), some of which also function as surfactants. Exemplary anti-foam agents include, Y-30® (Dow Corning), poly-glycol copolymers, oxy/ethoxylated alcohols, and polydimethylsiloxanes. In some embodiments, the anti-foam can be present at about 0.001% (v/v) to about 5% (v/v), about 0.01% (v/v) to about 5% (v/v), about 0.1% (v/v) to about 5% (v/v), or about 0.1% (v/v) to about 2% (v/v). In some embodiments, the anti-foam agent can be present at about 0.001% (v/v), about 0.01% (v/v), about 0.1% (v/v), about 0.5% (v/v), about 1% (v/v), about 2% (v/v), about 3% (v/v), about 4% (v/v), or about 5% (v/v) or more as desirable to promote the reaction.

The quantities of reactants used in the kinase reaction will generally vary depending on the quantities of product desired, and concomitantly the amount of acetate kinase substrate employed. Those having ordinary skill in the art will readily understand how to vary these quantities to tailor them to the desired level of productivity and scale of production.

In some embodiments, the order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the cofactor, co-substrate, acetate kinase, and substrate may be added first to the solvent.

The solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a pre-chilled lyophilization chamber, followed by the application of a vacuum.

For improved mixing efficiency when an aqueous co-solvent system is used, the acetate kinase, and cofactor may be added and mixed into the aqueous phase first. The organic phase may then be added and mixed in, followed by addition of the acetate kinase substrate and co-substrate. Alternatively, the acetate kinase substrate may be premixed in the organic phase, prior to addition to the aqueous phase.

The phosphorylation process is generally allowed to proceed until further conversion of substrate to phosphorylated product does not change significantly with reaction time (e.g., less than 10% of substrate being converted, or less than 5% of substrate being converted). In some embodiments, the reaction is allowed to proceed until there is complete or near complete conversion of substrate to product. Transformation of substrate to product can be monitored using known methods by detecting substrate and/or product, with or without derivatization. Suitable analytical methods include gas chromatography, HPLC, MS, and the like.

In some embodiments of the process, the suitable reaction conditions comprise a substrate loading of at least about 5 g/L, 10 g/L, 20 g/L, 30 g/L, 40 g/L, 50 g/L, 60 g/L, 70 g/L, 100 g/L, or more, and wherein the method results in at least about 50%, 60%, 70%, 80%, 90%, 95% or greater conversion of substrate compound to product compound in about 48 h or less, in about 36 h or less, in about 24 h or less, or in about 3 h or less.

In further embodiments of the processes for converting substrate compound to product compound using the engineered acetate kinase polypeptides, the suitable reaction conditions can comprise an initial substrate loading to the reaction solution which is then contacted by the polypeptide. This reaction solution is then further supplemented with additional substrate compound as a continuous or batchwise addition over time at a rate of at least about 1 g/L/h, at least about 2 g/L/h, at least about 4 g/L/h, at least about 6 g/L/h, or higher. Thus, according to these suitable reaction conditions, polypeptide is added to a solution having an initial substrate loading of at least about 20 g/L, 30 g/L, or 40 g/L. This addition of polypeptide is then followed by continuous addition of further substrate to the solution at a rate of about 2 g/L/h, 4 g/L/h, or 6 g/L/h until a much higher final substrate loading of at least about 30 g/L, 40 g/L, 50 g/L, 60 g/L, 70 g/L, 100 g/L, 150 g/L, 200 g/L or more, is reached. Accordingly, in some embodiments of the process, the suitable reaction conditions comprise addition of the polypeptide to a solution having an initial substrate loading of at least about 20 g/L, 30 g/L, or 40 g/L followed by addition of further substrate to the solution at a rate of about 2 g/L/h, 4 g/L/h, or 6 g/L/h until a final substrate loading of at least about 30 g/L, 40 g/L, 50 g/L, 60 g/L, 70 g/L, 100 g/L or more, is reached. This substrate supplementation reaction condition allows for higher substrate loadings to be achieved while maintaining high rates of conversion of substrate to phosphorylated product of at least about 50%, 60%, 70%, 80%, 90% or greater conversion of substrate.

In some embodiments, acetate kinase and acetyl phosphate recycle ADP to ATP. In some embodiments, acetate kinase and acetyl phosphate recycle an ADP analogue to an ATP analogue. In some embodiments, acetate kinase and acetyl phosphate recycle F-thioADP (5) to F-thioATP (3).

In some embodiments of the processes, the reaction using an engineered acetate kinase polypeptide can comprise the following suitable reaction conditions: (a) substrate loading at about 40 g/L; (b) about 0.05 g/L of the engineered polypeptide; (c) 400 mM acetyl phosphate; (d) about 2 mM F-thioATP; (e) about 60 mM $MgCl_2$; (f) about 4 g/L adenylate kinase; (g) a pH of about 6.5; (h) temperature of about 25° C.; and (i) reaction time of about 3 hrs.

In some embodiments of the processes, the reaction using an engineered acetate kinase polypeptide can comprise the following suitable reaction conditions: (a) substrate loading at about 30 g/L; (b) about 0.05 g/L of the engineered polypeptide; (c) 290 mM acetyl phosphate; (d) about 7.3 mM F-thioATP; (e) about 60 mM $MgCl_2$; (f) about 0.5 g/L guanylate kinase; (g) a pH of about 7.5; (h) temperature of about 30° C.; and (i) reaction time of about 3 hrs.

In some embodiments, additional reaction components or additional techniques are carried out to supplement the reaction conditions. These can include taking measures to stabilize or prevent inactivation of the enzyme, reduce product inhibition, shift reaction equilibrium to product formation.

In further embodiments, any of the above described process for the conversion of substrate compound to product compound can further comprise one or more steps selected from: extraction; isolation; purification; and crystallization of product compound. Methods, techniques, and protocols for extracting, isolating, purifying, and/or crystallizing the product from biocatalytic reaction mixtures produced by the above disclosed processes are known to the ordinary artisan and/or accessed through routine experimentation. Additionally, illustrative methods are provided in the Examples below.

Various features and embodiments of the invention are illustrated in the following representative examples, which are intended to be illustrative, and not limiting.

EXPERIMENTAL

The following Examples, including experiments and results achieved, are provided for illustrative purposes only and are not to be construed as limiting the present invention. Indeed, there are various suitable sources for many of the reagents and equipment described below. It is not intended that the present invention be limited to any particular source for any reagent or equipment item.

In the experimental disclosure below, the following abbreviations apply: M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); psi and PSI (pounds per square inch); ° C. (degrees Centigrade); RT and rt (room temperature); CV (coefficient of variability); CAM and cam (chloramphenicol); PMBS (polymyxin B sulfate); IPTG (isopropyl β-D-1-thiogalactopyranoside); LB (lysogeny broth); TB (terrific broth); SFP (shake flask powder); CDS (coding sequence); DNA (deoxyribonucleic acid); RNA (ribonucleic acid); nt (nucleotide; polynucleotide); aa (amino acid; polypeptide); E. coli W3110 (commonly used laboratory E. coli strain, available from the Coli Genetic Stock Center [CGSC], New Haven, CT); HTP (high throughput); HPLC (high pressure liquid chromatography); HPLC-UV (HPLC-Ultraviolet Visible Detector); 1H NMR (proton nuclear magnetic resonance spectroscopy); FIOPC (fold improvements over positive control); Sigma and Sigma-Aldrich (Sigma-Aldrich, St. Louis, MO); Difco (Difco Laboratories, BD Diagnostic Systems, Detroit, MI); Microfluidics (Microfluidics, Westwood, MA); Life Technologies (Life Technologies, a part of Fisher Scientific, Waltham, MA); Amresco (Amresco, LLC, Solon, OH); Carbosynth (Carbosynth, Ltd., Berkshire, UK); Varian (Varian Medical Systems, Palo Alto, CA); Agilent (Agilent Technologies, Inc., Santa Clara, CA); Infors (Infors USA Inc., Annapolis Junction, MD); and Thermotron (Thermotron, Inc., Holland, MI).

Example 1

Production of Engineered Polypeptides in pCK110900

The polynucleotide (SEQ ID NO: 1) encoding the polypeptide, from *Thermotoga maritima* having acetate kinase activity (SEQ ID NO: 2) with an N-terminal his tag was cloned into a pCK110900 vector system (See e.g., U.S. Pat. No. 9,714,437, which is hereby incorporated by reference in its entirety). The polynucleotide was subsequently expressed in *E. coli* W3110fhuA under the control of the lac promoter.

In a 96-well format, single colonies were picked and grown in 190 μL LB containing 1% glucose and 30 μg/mL chloramphenicol (CAM) at 30° C. at 200 rpm with 85% relative humidity. Following overnight growth, 20 μL of the grown cultures were transferred into a deep-well plate containing 380 μL of TB with 30 μg/mL CAM. The cultures were grown at 30° C. at 250 rpm with 85% relative humidity for approximately 2.25 hours. When the optical density ($OD_{600}$) of the cultures reached 0.4-0.6, expression of the acetate kinase gene was induced by addition of IPTG to a final concentration of 1 mM. Following induction, growth was continued for 18-20 hours at 30° C. at 250 rpm with 85% relative humidity. Cells were harvested by centrifugation at 4,000 rpm at 4° C. for 10-20 minutes and the media discarded. The cell pellets were stored at −80° C. until ready for use. Prior to performing the assay, cell pellets were resuspended in 200 μL of lysis buffer containing 10 mM Tris-HCl, pH 7.5, with 1 g/L lysozyme and 0.5 g/L PMBS. The plates were agitated with medium-speed shaking for 2 hours on a microtiter plate shaker at room temperature. The plates were then centrifuged at 4,000 rpm for 15-20 minutes at 4° C., and the clarified supernatants were used in the HTP assay reaction described below.

Shake-flask procedures can be used to generate engineered acetate kinase polypeptide shake flask powders, which are useful for secondary screening assays and/or use in the biocatalytic processes described herein. Shake flask powder (SFP) preparation of enzymes provides a more purified preparation (e.g., up to 30% of total protein) of the engineered enzyme, as compared to the cell lysate used in HTP assays and also allows for the use of more concentrated enzyme solutions. To start the cultures, a single colony of *E. coli*, transformed with a plasmid encoding an engineered polypeptide of interest, was inoculated into 6 mL LB with 30 μg/mL CAM and 1% glucose. The culture was grown overnight (at least 16 hours) in an incubator at 30° C. with shaking at 250 rpm. Following the overnight growth, 5 mL of the culture was inoculated into 250 mL of TB with 30 μg/mL CAM in a 1 L shake flask. The 250 mL culture was grown at 30° C. at 250 rpm for 2-3 hours until $OD_{600}$ reached 0.6-0.8. Expression of the acetate kinase gene was induced by addition of IPTG to a final concentration of 1 mM. Growth was continued for an additional 18-20 hours at 30° C. at 250 rpm. Cells were harvested by transferring the culture into a pre-weighed centrifuge bottle, then centrifuged at 4,000 rpm for 20 minutes at 4° C. The supernatant was discarded. The cell pellet was resuspended in 30 mL of 10 mM Tris, pH 7.5, then centrifuged again at 4,000 rpm for 20 minutes at 4° C. and the supernatant discarded. The remaining cell pellet was weighed. In some embodiments, the cells are stored at −80° C. until ready to use. For lysis, the cell pellet was resuspended in 30 mL of cold 10 mM Tris, pH 7.5. The resuspended cells were lysed using a 110 L MICROFLUIDIZER® processor system (Microfluidics). Cell debris was removed by centrifugation at 10,000 rpm for 60 minutes at 4° C. The clarified lysate was collected, frozen at −80° C., and then lyophilized, using standard methods known in the art. Lyophilization of frozen clarified lysate provides a dry shake-flask powder comprising crude engineered polypeptide.

Example 2

Evolution and Screening of Engineered Polypeptides Derived from SEQ ID NO: 2 for Improved Acetate Kinase (AcK) Activity for Production of F-thioGTP (2)

The engineered polynucleotide (SEQ ID NO: 1) encoding the polypeptide with acetate kinase activity of SEQ ID NO:

2 was used to generate the engineered polypeptides of Table 2-1 and 2-2. These polypeptides displayed improved acetate kinase activity under the desired conditions (e.g., the recycling of F-thioATP (3) from F-thioADP (5) and acetyl phosphate in the guanylate kinase reaction scheme (Scheme 4), as well as the conversion of F-thioGDP (7) to F-thioGTP (2)) as compared to the starting polypeptide. The engineered polypeptides having the amino acid sequences of even-numbered sequence identifiers were generated from the "backbone" amino acid sequence of SEQ ID NO: 2, as described, and identified using the HTP assay described below and analytical methods shown in Table 2-2.

Directed evolution began with the polynucleotide set forth in SEQ ID NO: 1. Libraries of engineered polypeptides were generated using various well-known techniques (e.g., saturation mutagenesis, recombination of previously identified beneficial amino acid differences) and screened using HTP assay and analysis methods described below.

The enzyme assay was carried out in 96-well deep-well (2 mL) plates, in 100 μL total volume/well. Clarified acetate kinase-containing lysates were incubated at 60° C. for 2 hours prior to the assay to denature the endogenous *E. coli* acetate kinase, which was not as thermostable as the acetate kinase from *Thermotoga maritima*. The reactions were carried out using 0.05% (v/v), 60° C.-heated HTP lysate, 5 mM F-thioATP (3), 4 g/L purified guanylate kinase SFP (SEQ ID NO: 551), 30 mM $MgCl_2$, 200 mM acetyl phosphate, and 55 mM F-thioGMP (6). The reactions were set up by adding the following: 50.7 μL of a master mix solution containing 9.9 mM F-thioATP (3), 59.1 mM $MgCl_2$, 394.4 mM acetyl phosphate, and 7.9 g/L purified guanylate kinase (SEQ ID NO: 551) (the pH of the solution was adjusted to 6.5); 39.3 μL of 140 mM F-thioGMP (6); and 10 μL of 0.5% v/v 60° C.-heated HTP lysate. The reaction plate was heat-sealed and centrifuged briefly. The plates were then shaken at 500 rpm at 25° C. for 3 hours.

After the 3-hour incubation, 100 μL of acetonitrile were added to each well, and the plates were re-sealed and shaken for 10-20 minutes at room temperature. The plates were centrifuged at 4,000 rpm for at least 10 minutes to remove denatured proteins from solution. Samples were diluted 100-fold in water prior to HPLC analysis.

Hit variants were grown in 250-mL shake flask and shake flask powders generated. The activity of the SFP were evaluated at 0.1-1 g/L, using 5 mM F-thio-ATP (3), 0.5 g/L purified guanylate kinase (SEQ ID NO: 551), 30 mM $MgCl_2$, 200 mM acetyl phosphate, and 55 mM F-thioGMP (6), at pH 6.5. The reactions were set up using a similar procedure as described above.

TABLE 2-1

Improved Acetate Kinase Variants Relative to SEQ ID NO: 2 for the Formation of F-thioGTP (2)

| SEQ ID NO: (nt/aa) | Amino Acid Differences (Relative to SEQ ID NO: 2) | Conversion Fold Improvement (Relative to SEQ ID NO: 2)[1] |
|---|---|---|
| 3/4 | H4-/A142V/L242T | +++ |
| 5/6 | M294L | ++ |
| 7/8 | E298G | ++ |
| 9/10 | V15N | ++ |
| 11/12 | E298S | ++ |
| 13/14 | L51F | ++ |
| 15/16 | I76V | ++ |
| 17/18 | I23H | ++ |
| 19/20 | E298G/E377Q | ++ |
| 21/22 | A135T/V392W | ++ |
| 23/24 | R12K/I76V/C232S | ++ |
| 25/26 | E298T | ++ |
| 27/28 | T191I | ++ |
| 29/30 | I76V/C232S/I262L/Y284L/R386K | ++ |
| 31/32 | R374S | + |
| 33/34 | I76V/I262L | + |
| 35/36 | G343S | + |
| 37/38 | G39A | + |
| 39/40 | A135T/Y284T | + |
| 41/42 | K145E/I400V | + |
| 43/44 | A41F | + |
| 45/46 | I76V/L364I | + |
| 47/48 | R374P | + |
| 49/50 | E298L/K405E | + |
| 51/52 | D275T | + |
| 53/54 | C232S | + |
| 55/56 | R374H | + |
| 57/58 | T372L | + |
| 59/60 | V392W | + |
| 61/62 | D275H | + |
| 63/64 | I297N | + |
| 65/66 | T372C | + |
| 67/68 | I373P | + |
| 69/70 | K376V | + |
| 71/72 | R374D | + |
| 73/74 | T372R | + |
| 75/76 | D57R | + |
| 77/78 | I76V/Y284L/E299D | + |
| 79/80 | I76V/I262L/L364I | + |
| 81/82 | R374A | + |
| 83/84 | R374L | + |
| 85/86 | R12K/I76V/I164M/Y284L | + |
| 87/88 | I76V/I262L/M273V | + |
| 89/90 | I76V/M273V | + |
| 91/92 | R374W | + |
| 93/94 | T372N | + |
| 95/96 | G285T | + |
| 97/98 | E47A | + |
| 99/100 | I76V/I164M/C232S/I262L/R386K | + |
| 101/102 | E298W | + |
| 103/104 | V391G | + |
| 105/106 | K288S | + |
| 107/108 | P130V | + |
| 109/110 | R374M | + |
| 111/112 | R374Q | + |
| 113/114 | E47W | + |
| 115/116 | F290L | + |
| 117/118 | C232S/R386K | + |
| 119/120 | E47S | + |
| 121/122 | I23N | + |
| 123/124 | G343C | + |
| 125/126 | K288T | + |
| 127/128 | R54V | + |
| 129/130 | I76V/C232S/L364I/R386K | + |
| 131/132 | V52W | + |
| 133/134 | I76V/I164M/I262L/Y284L | + |
| 135/136 | E298V | + |
| 137/138 | T372V | + |
| 139/140 | S292P | + |
| 141/142 | E298L | + |
| 143/144 | K376S | + |

[1] Levels of increased activity were determined relative to the reference polypeptide of SEQ ID NO: 2 and defined as follows: "+" 1.15 to 1.45, "++" > 1.45, "+++" > 2.00

TABLE 2-2

Table 2-2. UPLC Parameters

| Instrument | Thermo U3000 UPLC | | |
|---|---|---|---|
| Column | Chromolith RP18 25 × 4.6 mm chiral method | | |
| | 0 | 96 | 4 |
| | 1.6 | 94 | 6 |
| | 1.61 | 0 | 100 |
| | 1.8 | 0 | 100 |
| | 1.81 | 96 | 4 |
| | 3 | 96 | 4 |
| Flow Rate | 1.5 mL/min | | |
| Detector | UV detector 210 nm | | |
| Run time | 2.5 min | | |
| Peak Retention Times | F-thioGMP (6) at 0.38 minutes, F-thioGTP (2) at 0.69 minutes, F-thioAMP (4) at 0.7 minutes, and F-thioATP (3) at 1.35 minutes | | |
| Column Temperature | 55° C. | | |
| Sample Temperature | Room temperature | | |
| Injection Volume | 5 μL | | |

Example 3

Evolution and Screening of Engineered Polypeptides Derived from SEQ ID NO: 2 for Improved Acetate Kinase (AcK) Activity for Production of F-thioATP (3)

The engineered polynucleotide (SEQ ID NO: 1) encoding the polypeptide with acetate kinase activity of SEQ ID NO: 2 was used to generate the engineered polypeptides in Table 3-1. These polypeptides displayed improved acetate kinase activity under the desired conditions (e.g., the recycling of F-thioATP (3) from F-thioADP (5) and acetyl phosphate in the adenylate kinase reaction scheme (Scheme 3), as well as the conversion of F-thioADP (5) to F-thioATP (3)) as compared to the starting polypeptide. The engineered polypeptides having the amino acid sequences of even-numbered sequence identifiers were generated from the "backbone" amino acid sequence of SEQ ID NO: 2, as described, and identified using the HTP assay described below and analytical methods described in Table 2-2.

Directed evolution began with the polynucleotide set forth in SEQ ID NO: 1. Libraries of engineered polypeptides were generated using various well-known techniques (e.g., saturation mutagenesis, recombination of previously identified beneficial amino acid differences) and screened using HTP assay and analysis methods, as indicated.

The enzyme assay was carried out in 96-well deep-well (2 mL) plates, in 100 μL total volume/well. Clarified acetate kinase-containing lysates were incubated at 60° C. for 2 hours prior to the assay to denature the endogenous E. coli acetate kinase, which was not as thermostable as the acetate kinase from Thermotoga maritima. The reactions were carried out using 0.2% (v/v) 60° C.-heated HTP lysates, 1 mM F-thioATP (3), 8 g/L adenylate kinase SFP (SEQ ID NO: 553), 30 mM MgCl$_2$, 200 mM acetyl phosphate, and 55 mM F-thioAMP. The reactions were set up by adding the following: 40.4 μL of master mix solution containing 2.5 mM F-thioATP (3), 74.3 mM MgCl$_2$, and 495.5 mM acetyl phosphate (the pH of the solution was adjusted to 6.5); 19.6 μL of 280 mM F-thioAMP (4); 20 μL of 40 g/L adenylate kinase SFP (SEQ ID NO: 553); and 20 μL of 1% v/v 60° C.-heated HTP lysate. The reaction plate was heat-sealed and centrifuged briefly. The plates were then shaken at 500 rpm at 25° C. for 3 hours.

Following the 3-hour incubation, 100 μL of acetonitrile were added to each well, and the plates were re-sealed and shaken for 10-20 minutes at room temperature. Water, 800 μL, was then added to each well, and the plates were re-sealed and shaken for 5-10 minutes. The plates were centrifuged at 4,000 rpm for at least 10 minutes to remove denatured proteins from solution. Samples were diluted 200-fold in water prior to HPLC analysis.

Hit variants were grown in 250-mL shakeflask and enzyme powders generated. The activity of the enzyme powders were evaluated at 0.01-0.2 g/L acetate kinase enzyme powder, 1 mM F-thio-ATP (3), 8 g/L adenylate kinase SFP (SEQ ID NO: 553), 30 mM MgCl$_2$, 200 mM acetyl phosphate, and 55 mM F-thioAMP (4), at pH 6.5. The reactions were set up using a similar procedure as described above.

TABLE 3-1

Improved Acetate Kinase Variants Relative to SEQ ID NO: 2 for the Formation of F-thioATP (3)

| SEQ ID NO: (nt/aa) | Amino Acid Differences (Relative to SEQ ID NO: 2) | Conversion Fold Improvement (Relative to SEQ ID NO: 2)[1] |
|---|---|---|
| 3/4 | H4-/A142V/L242T | +++ |
| 17/18 | I23H | ++ |
| 21/22 | A135T/V392W | ++ |
| 37/38 | G39A | ++ |
| 9/10 | V15N | ++ |
| 145/146 | I76V/I262L/Y284L/L364I | ++ |
| 147/148 | E58S/A135T | ++ |
| 27/28 | T191I | ++ |
| 43/44 | A41F | ++ |
| 149/150 | G39T | + |
| 151/152 | D57S/A135T | + |
| 153/154 | H132G | + |
| 121/122 | I23N | + |
| 39/40 | A135T/Y284T | + |
| 155/156 | I373S | + |
| 157/158 | I76V/C232S/P259V/L364I | + |
| 159/160 | G39S | + |
| 49/50 | E298L/K405E | + |
| 161/162 | T372G | + |
| 13/14 | L51F | + |
| 163/164 | I76V/I164M/M273V | + |
| 103/104 | V391G | + |
| 139/140 | S292P | + |
| 67/68 | I373P | + |
| 129/130 | I76V/C232S/L364I/R386K | + |
| 165/166 | F290V | + |
| 167/168 | N220G | + |
| 169/170 | G45L | + |
| 119/120 | E47S | + |
| 171/172 | V311A/L364I/R386K | + |
| 173/174 | I76V/Y284L/V311A/R386K | + |
| 81/82 | R374A | + |
| 175/176 | S287T | + |
| 177/178 | G343T | + |
| 93/94 | T372N | + |
| 179/180 | I76V/C232S | + |
| 181/182 | F290L | + |
| 183/184 | G285S | + |
| 5/6 | M294L | + |
| 45/46 | I76V/L364I | + |
| 185/186 | A340G | + |
| 187/188 | V15A | + |
| 189/190 | V15S | + |
| 191/192 | E47R | + |
| 193/194 | I76V | + |
| 195/196 | E58W | + |
| 197/198 | D275F | + |
| 199/200 | K288H | + |
| 201/202 | M294F | + |
| 77/78 | I76V/Y284E/E299D | + |
| 203/204 | E47N | + |

TABLE 3-1-continued

Improved Acetate Kinase Variants Relative to SEQ
ID NO: 2 for the Formation of F-thioATP (3)

| SEQ ID NO: (nt/aa) | Amino Acid Differences (Relative to SEQ ID NO: 2) | Conversion Fold Improvement (Relative to SEQ ID NO: 2)[1] |
|---|---|---|
| 205/206 | G289S | + |
| 51/52 | D275T | + |
| 89/90 | I76V/M273V | + |
| 207/208 | V246Y | + |
| 209/210 | V311A | + |
| 31/32 | R374S | + |
| 211/212 | E47M | + |
| 33/34 | I76V/I262L | + |
| 47/48 | R374P | + |
| 213/214 | F290R | + |
| 215/216 | K279R | + |
| 57/58 | T372L | + |
| 217/218 | P347S | + |
| 219/220 | I76V/C232S/M273V/E299D/V311A/R386K | + |
| 61/62 | D275H | + |
| 221/222 | I76V/I164M/R386K | + |
| 95/96 | G285T | + |
| 41/42 | K145E/I400V | + |
| 223/224 | S287L | + |
| 225/226 | E299W | + |
| 227/228 | V392P | + |
| 91/92 | R374W | + |
| 229/230 | T372D | + |
| 231/232 | E299V | + |
| 233/234 | G375P | + |
| 235/236 | I76V/I262L/Y284L/S287T/R386K | + |
| 237/238 | I44V | + |
| 79/80 | I76V/I262L/L364I | + |
| 239/240 | G45W | + |
| 241/242 | F290I | + |
| 243/244 | E47P | + |
| 245/246 | S287G | + |
| 87/88 | I76V/I262L/M273V | + |
| 247/248 | V55S | + |
| 249/250 | K288R | + |
| 251/252 | V246Q | + |
| 253/254 | E47I | + |
| 255/256 | R12K/I76V/I164M | + |
| 257/258 | H53I | + |
| 73/74 | T372R | + |
| 259/260 | S287N | + |
| 261/262 | I76V/I164M/S287T/L364I | + |
| 99/100 | I76V/I164M/C232S/I262L/R386K | + |
| 263/264 | E58N/A135T | + |
| 265/266 | F290H | + |
| 107/108 | P130V | + |
| 267/268 | I76V/R386K | + |
| 269/270 | D275S | + |
| 63/64 | I297N | + |
| 271/272 | V283M | + |
| 273/274 | T191V | + |
| 275/276 | I164M/C232S/Y284L/S287T | + |
| 277/278 | G343T/K388I | + |
| 279/280 | I76V/I164M | + |
| 281/282 | N220S/L360V | + |
| 283/284 | K405E | + |
| 285/286 | E299Q | + |
| 287/288 | P347I | + |
| 289/290 | I76V/I262L/S287T | + |
| 291/292 | L364I | + |
| 293/294 | E47S/I411F | + |
| 295/296 | R50Q | + |
| 297/298 | I76V/C232S/I262L | + |
| 299/300 | V61T | + |
| 301/302 | P347Q | + |
| 303/304 | G48R | + |
| 305/306 | I76V/I164M/I262L | + |
| 71/72 | R374D | + |
| 307/308 | G332D | + |
| 309/310 | D275Y | + |
| 311/312 | P241T | + |
| 143/144 | K376S | + |
| 137/138 | T372V | + |
| 313/314 | S292R | + |
| 315/316 | V61S | + |
| 317/318 | I76V/A142V/E299D/R386K | + |
| 319/320 | M273V/V311A/E313D/L364I | + |
| 321/322 | G343E | + |
| 323/324 | I262L/Y284L/S287T | + |
| 141/142 | E298L | + |

[1]Levels of increased activity were determined relative to the reference polypeptide of SEQ ID NO: 2 and defined as follows: "+" 1.15 to 2.00, "++" > 2.00, "+++" > 6.00

Example 4

Evolution and Screening of Engineered Polypeptides Derived from SEQ ID NO: 4 for Improved Acetate Kinase (AcK) Activity for the Formation of F-thioGTP (2)

The engineered polynucleotide (SEQ ID NO: 3) encoding the polypeptide with acetate kinase activity of SEQ ID NO: 4 was used to generate the engineered polypeptides of Table 4-1. These polypeptides displayed improved acetate kinase activity under the desired conditions (e.g., the recycling of F-thioATP (3) from F-thioADP (5) and acetyl phosphate in the guanylate kinase reaction scheme, as well as the conversion of F-thioADP (3) to F-thioATP (5)) as compared to the starting polypeptide. The engineered polypeptides having the amino acid sequences of even-numbered sequence identifiers were generated from the "backbone" amino acid sequence of SEQ ID NO: 4, as described, and identified using the HTP assay described below and analytical methods described in Table 2-2.

Directed evolution began with the polynucleotide set forth in SEQ ID NO: 3. Libraries of engineered polypeptides were generated using various well-known techniques (e.g., saturation mutagenesis, recombination of previously identified beneficial amino acid differences) and screened using HTP assay and analysis methods, as indicated.

The enzyme assay was carried out in 96-well deep-well (2 mL) plates, in 100 μL total volume/well. Clarified acetate kinase-containing lysates were incubated at 60° C. for 2 hours prior to the assay to denature the endogenous *E. coli* acetate kinase, which was not as thermostable as the acetate kinase from *Thermotoga maritima*. The reactions were carried out using 0.05% (v/v), 60° C.-heated HTP lysates, 7.27 mM F-thioATP (3), 1 g/L guanylate kinase SFP (SEQ ID NO: 552), 43.6 mM MgCl$_2$, 291 mM acetyl phosphate, and 80 mM F-thioGMP (6). The reactions were set up by adding the following: 46.7 μL of the master mix solution containing 15.6 mM F-thioATP (3), 93.4 mM MgCl$_2$, and 623.1 mM acetyl phosphate (the pH of the solution was adjusted to 6.5); 33.3 μL of 240 mM F-thioGMP (6); 10 μL of 10 g/L guanylate kinase SFP (SEQ ID NO: 552); 10 μL of 0.5% v/v 60° C.-heated HTP lysate. The reaction plate was heat-sealed and centrifuged briefly. The plates were then shaken at 500 rpm at 25° C. for 3 hours.

Following the 3-hour incubation, 100 μL of acetonitrile were added to each well, and the plates were re-sealed and shaken for 10-20 minutes at room temperature. The plates were centrifuged at 4,000 rpm for at least 10 minutes to remove denatured proteins from solution. Samples were diluted 200-fold in water prior to HPLC analysis Hit variants were grown in 250-mL shakeflask and enzyme powders generated. The activity of the enzyme powders were evaluated at 0.05-0.5 g/L of the acetate kinase SFP, 80 mM F-thioGMP (6), 7.27 mM F-thioATP (3), 43.6 mM MgCl$_2$, 290.9 mM acetyl phosphate, and 0.5 g/L guanylate kinase (SEQ ID NO: 552), pH 6.5. The reactions were set up using a similar procedure as described above.

TABLE 4-1

Improved Acetate Kinase Variants Relative to SEQ ID NO: 2 for the Formation of F-thioGTP (2). Amino acid differences were based on SEQ ID NO: 2, while Fold Improvement is relative to SEQ ID NO: 4. SEQ ID NO: 4 has a 5x Histidine tag, instead of 6x Histidine

| SEQ ID NO: (nt/aa) | Amino Acid Differences (Relative to SEQ ID NO: 2) | Conversion Fold Improvement (Relative to SEQ ID NO: 4)[1] |
|---|---|---|
| 325/326 | H4-/A142V/L242T/M294L/I297V/E298G | +++ |
| 327/328 | H4-/A142V/C232S/L242T/M294L/I297V/R374D | ++ |
| 329/330 | H4-/A142V/L242T/G285S/M294L/V311A/G343T/T372G | ++ |
| 331/332 | H4-/L51F/A142V/L242T/Y284L/M294L/G343C/R374D | ++ |
| 333/334 | H4-/A142V/E242T/M294E/G343C/R374D | ++ |
| 335/336 | H4-/I23H/A142V/L242T/Y284L/M294L/I297S | ++ |
| 337/338 | H4-/I76V/A142V/L242T/M294L/I297V/R374D | ++ |
| 339/340 | H4-/A142V/L242T/M294L/I297V/R374D | ++ |
| 341/342 | H4-/A142V/L242T/G285S/M294L/V391G/V392P | ++ |
| 343/344 | H4-/I76V/A142V/L242T/M294L/V392P | ++ |
| 345/346 | H4-/E47A/A142V/L242T/M294L | ++ |
| 347/348 | H4-/A142V/L242T/M294L/T372D | ++ |
| 349/350 | H4-/A142V/L242T/Y284L/M294L/I297V/G343C | ++ |
| 351/352 | H4-/A142V/L242T/M294L/I297V/G343C/R374D | ++ |
| 353/354 | H4-/A142V/L242T/M294L | ++ |
| 355/356 | H4-/G48R/A142V/L242T/M294L/V311A/T372D | ++ |
| 357/358 | H4-/A142V/C232S/L242T/G343C/R374D | ++ |
| 359/360 | H4-/I76V/A142V/L242T/M294L/G343C | ++ |
| 361/362 | H4-/L51F/A142V/L242T/M294L/I297V | ++ |
| 363/364 | H4-/A142V/L242T/M294L/V391G | + |
| 365/366 | H4-/A142V/L242T/M294L/I297V | + |
| 367/368 | H4-/A142V/L242T/M294L/I297S/R374D | + |
| 369/370 | H4-/G48R/A142V/L242T/G285S/T372G/V392P | + |
| 371/372 | H4-/A142V/L242T/G343T/T372D/V392P | + |
| 373/374 | H4-/A142V/L242T/Y284L/M294L/I297V | + |
| 375/376 | H4-/L51F/A142V/C232S/L242T/Y284L/G343C | + |
| 377/378 | H4-/A142V/L242T/G343C | + |
| 379/380 | H4-/A142V/L242T/Y284L/I297V/E298G/G343C | + |
| 381/382 | H4-/E47A/L51F/A142V/L242T/M294L/I297V | + |
| 383/384 | H4-/I76V/A142V/L242T/G343T/T372G | + |
| 385/386 | H4-/G48R/A142V/L242T/G343T/V392P | + |
| 387/388 | H4-/L51F/A142V/L242T/Y284L/M294L/I297V | + |
| 389/390 | H4-/E47S/G48R/A142V/L242T/G285S/M294L | + |
| 391/392 | H4-/G48R/I76V/A142V/L242T/G285S/M294L/T372G | + |
| 393/394 | H4-/A142V/L242T/T372G/V391G | + |
| 395/396 | H4-/A142V/L242T/G285T/M294L/V391G | + |
| 397/398 | H4-/A142V/L242T/G285T/G343T/T372D | + |
| 399/400 | H4-/A142V/L242T/Y284L/I297V/R374D | + |
| 401/402 | H4-/A142V/L242T/I297V/E298G | + |
| 403/404 | H4-/A142V/L242T/Y284L/L357P | + |
| 405/406 | H4-/E47A/L51F/A142V/L242T/Y284L/I297V/E298G/R374D | + |
| 407/408 | H4-/L51F/I76V/A142V/L242T/R374D | + |
| 409/410 | H4-/A142V/L242T/V391G/V392P | + |
| 411/412 | H4-/V15N/A142V/L242T/G285T/T372D | + |
| 413/414 | H4-/A142V/L242T/G285S/G343T/T372D | + |
| 415/416 | H4-/A142V/L242T/T372G | + |
| 417/418 | H4-/V15N/L51F/A142V/C232S/L242T/Y284L/I297S | + |
| 419/420 | H4-/E47A/L51F/V55A/A142V/L242T/G343C/R374D | + |
| 421/422 | H4-/A142V/L242T/F290M/I373S/R374A | + |
| 423/424 | H4-/A142V/C232S/L242T/I297V/G343C | + |
| 425/426 | H4-/E47S/G48R/A142V/L242T/G285S/V392P | + |
| 427/428 | H4-/A142V/L242T/Y284L/I297S/G343C/R374D | + |
| 429/430 | H4-/I23H/A142V/L242T/I297S/R374D | + |
| 431/432 | H4-/I23H/A142V/L242T/I297V | + |
| 433/434 | H4-/A142V/L242T/I297V/G343C | + |
| 435/436 | H4-/I76V/A142V/L242T/G343T/T372D | + |
| 437/438 | H4-/L51F/I76V/A142V/L242T/Y284L/M294L/I297T | + |
| 439/440 | H4-/V15N/E47A/I76V/A142V/L242T/M294L/I297V/G343C | + |
| 441/442 | H4-/I23H/A142V/C232S/L242T/Y284L/R374D | + |
| 443/444 | H4-/A142V/L242T/G285T/G343T/V391G | + |
| 445/446 | H4-/E47A/L51F/A142V/L242T/M294L/E298G | + |
| 447/448 | H4-/V15N/E47A/A142V/L242T/M294L | + |
| 449/450 | H4-/A142V/L242T/F290R/I373P/R374P | + |

TABLE 4-1-continued

Improved Acetate Kinase Variants Relative to SEQ ID NO: 2 for the
Formation of F-thioGTP (2). Amino acid differences were based
on SEQ ID NO: 2, while Fold Improvement is relative to SEQ ID
NO: 4. SEQ ID NO: 4 has a 5x Histidine tag, instead of 6x Histidine

| SEQ ID NO: (nt/aa) | Amino Acid Differences (Relative to SEQ ID NO: 2) | Conversion Fold Improvement (Relative to SEQ ID NO: 4)[1] |
|---|---|---|
| 451/452 | H4-/E47S/A142V/L242T | + |
| 453/454 | H4-/V15S/E47S/A142V/L242T/G285S/G343T/T372G | + |
| 455/456 | H4-/G39A/A142V/L242T/I297V/R374D | + |
| 457/458 | H4-/E47R/G48R/A142V/L242T/G285S/V391G/V392P | + |
| 459/460 | H4-/L51F/A142V/L242T/S269G/F290R/I373S/R374A | + |
| 461/462 | H4-/V15N/A142V/L242T | + |
| 463/464 | H4-/L51F/A142V/L242T/F290R/I373P/R374A | + |
| 465/466 | H4-/V15S/A142V/L242T/V311A/V392P | + |
| 467/468 | H4-/V15N/I76 V/A142V/L242T | + |
| 469/470 | H4-/A142V/L242T/Y284L/I297V | + |
| 471/472 | H4-/L51F/A142V/C232S/L242T/R374D | + |
| 473/474 | H4-/V15N/A142V/L242T/R374D | + |
| 475/476 | H4-/I76V/A142V/L242T/G285S/V392P | + |
| 477/478 | H4-/A142V/L242T/R374D | + |
| 479/480 | H4-/I23N/A142V/L242T/I373P/R374A | + |
| 481/482 | H4-/A142V/L242T/V311A/T372G/V392P | + |
| 483/484 | H4-/L51F/A142V/L242T/F290V/I373P/R374A | + |
| 485/486 | H4-/G39A/A142V/L242T/Y284L/I297V/R374D | + |
| 487/488 | H4-/L51F/I76 V/A142V/L242T/I297V | + |
| 489/490 | H4-/I23H/I76V/A142V/L242T/G343C | + |
| 491/492 | H4-/E47S/A142V/L242T/G285S/T372D | + |
| 493/494 | H4-/A41F/A142V/L242T/F290R/I373P/R374P | + |
| 495/496 | H4-/A142V/L242T/F290V | + |
| 497/498 | H4-/A142V/L242T/G285S/V391G | + |
| 499/500 | H4-/L51F/A142V/L242T/I373P | + |
| 501/502 | H4-/E47R/A142V/L242I/T372D/V391G/V392P | + |
| 503/504 | H4-/I23H/E47A/A142V/L242T/I297V/R374D | + |
| 505/506 | H4-/V15N/E47S/G48R/A142V/L242T | + |
| 507/508 | H4-/A142V/L242T/I373S/R374P | + |
| 509/510 | H4-/A142V/C232S/L242T/Y284L/G343C | + |
| 511/512 | H4-/E47A/L51F/I76V/A142V/L242T/R374D | + |
| 513/514 | H4-/V15N/E47A/A142V/L242T | + |
| 515/516 | H4-/A142V/L242T/V311A/G343T/V392P | + |
| 517/518 | H4-/A142V/L242T/I373S/R374A | + |

[1]Levels of increased activity were determined relative to the reference polypeptide of SEQ ID NO: 4 and defined as follows: "+" 1.2 to 2.00, "++" > 2.00, "+++" > 3.00

Example 5

Evolution and Screening of Engineered Polypeptides Derived from SEQ ID NO: 4 for Improved Acetate Kinase (AcK) Activity for the Formation of F-thioATP (3)

The engineered polynucleotide (SEQ ID NO: 3) encoding the polypeptide with acetate kinase activity of SEQ ID NO: 4 was used to generate the engineered polypeptides of Table 4-1. These polypeptides displayed improved acetate kinase activity under the desired conditions (e.g., the recycling of F-thioATP (3) from F-thioADP (5) and acetyl phosphate in the adenylate kinase reaction scheme, as well as the conversion of F-thioADP (5) to F-thioATP (3)) as compared to the starting polypeptide. The engineered polypeptides having the amino acid sequences of even-numbered sequence identifiers were generated from the "backbone" amino acid sequence of SEQ ID NO: 4, as described, and identified using the HTP assay described below and analytical methods described in Table 2-2.

Directed evolution began with the polynucleotide set forth in SEQ ID NO: 3. Libraries of engineered polypeptides were generated using various well-known techniques (e.g., saturation mutagenesis, recombination of previously identified beneficial amino acid differences) and screened using HTP assay and analysis methods, as indicated.

The enzyme assay was carried out in 96-well deep-well (2 mL) plates, in 100 µL total volume/well. Clarified acetate kinase-containing lysates were incubated at 60° C. for 2 hours prior to the assay to denature the less thermostable endogenous E. coli acetate kinase. The reactions were carried out using 0.05% (v/v), 60° C.-heated HTP lysates, 2 mM F-thioATP (3), 4 g/L adenylate kinase SFP (SEQ ID NO: 554), 60 mM MgCl$_2$, 400 mM acetyl phosphate, and 110 mM F-thioAMP (4). The reactions were set up by adding the following: 65.1 µL of a master mix solution containing 3.1 mM F-thioATP (3), 92.1 mM MgCl$_2$, and 614 mM acetyl phosphate (the pH of the solution was adjusted to 6.5); 19.9 µL of 554 mM F-thioAMP (4); 5 µL of 80 g/L adenylate kinase SFP (SEQ ID NO: 554); and 10 µL of 0.5% v/v 60° C.-heated HTP lysate. The reaction plate was heat-sealed and centrifuged briefly. The plates were then shaken at 500 rpm at 25° C. for 3 hours.

Following the 3-hour incubation, 100 µL of acetonitrile were added to each well, and the plates were re-sealed and shaken for 10-20 minutes at room temperature. Water, 800 µL was then added to each well, and the plates were re-sealed and shaken for 5-10 minutes. The plates were centrifuged at 4,000 rpm for at least 10 minutes to remove denatured proteins from solution. Samples were diluted 200-fold in water prior to HPLC analysis.

TABLE 5-1

Improved Acetate Kinase Variants Activity Relative to SEQ ID NO: 4 for the Formation of F-thioATP (3). Amino acid differences is based on SEQ ID NO:2, while fold improvement is based on SEQ ID NO: 4. SEQ ID NO: 4 has a 5x Histidine tag, instead of 6x Histidine

| SEQ ID NO: (nt/aa) | Amino Acid Differences (Relative to SEQ ID NO: 2) | Conversion Fold Improvement (Relative to SEQ ID NO: 4)[1] |
|---|---|---|
| 519/520 | H4-/G39A/E47A/L51F/I76V/A142V/L242T/R374D | +++ |
| 521/522 | H4-/I76V/A142V/L242T/M294L/I297S/E298G | +++ |
| 523/524 | H4-/A142V/L242T/G343C | ++ |
| 435/436 | H4-/I76V/A142V/L242T/G343T/T372D | ++ |
| 437/438 | H4-/L51F/I76V/A142V/L242T/Y284L/M294L/I297T | ++ |
| 525/526 | H4-/V15N/G39A/L51F/I76V/A142V/L242T/M294L/I297S | ++ |
| 527/528 | H4-/A142V/L242T/Y284L/I297V | ++ |
| 529/530 | H4-/V15N/A142V/L242T/G343T/V392P | ++ |
| 385/386 | H4-/G48R/A142V/L242T/G343T/V392P | ++ |
| 515/516 | H4-/A142V/L242T/V311A/G343T/V392P | ++ |
| 361/362 | H4-/L51F/A142V/L242T/M294L/I297V | ++ |
| 531/532 | H4-/A142V/L242T/I297V | ++ |
| 533/534 | H4-/A142V/L242T/M294L/G343T/V392P | + |
| 517/518 | H4-/A142V/L242T/I373S/R374A | + |
| 387/388 | H4-/L51F/A142V/L242T/Y284L/M294L/I297V | + |
| 343/344 | H4-/I76V/A142V/L242T/M294L/V392P | + |
| 471/472 | H4-/L51F/A142V/C232S/L242T/R374D | + |
| 333/334 | H4-/A142V/L242T/M294L/G343C/R374D | + |
| 449/450 | H4-/A142V/L242T/F290R/I373P/R374P | + |
| 535/536 | H4-/L51F/G104A/A142V/L242T/I297T/G343C | + |
| 495/496 | H4-/A142V/L242T/F290V | + |
| 537/538 | H4-/I76V/A142V/L242T/V391G/V392P | + |
| 539/540 | H4-/A142V/L242T/I373P | + |
| 487/488 | H4-/L51F/I76V/A142V/L242T/I297V | + |
| 541/542 | H4-/L51F/A142V/L242T/M294L | + |
| 347/348 | H4-/A142V/L242T/M294L/T372D | + |
| 433/434 | H4-/A142V/L242T/I297V/G343C | + |
| 543/544 | H4-/A142V/L242T/F290R/I373S | + |
| 545/546 | H4-/A142V/L242T/G343T | + |
| 547/548 | H4-/I76V/A142V/L242T/Y284L/I297S | + |
| 459/460 | H4-/L51F/A142V/L242T/S269G/F290R/I373S/R374A | + |
| 549/550 | H4-/L51F/A142V/L242T/I373S/R374A | + |
| 331/332 | H4-/L51F/A142V/L242T/Y284L/M294L/G343C/R374D | + |
| 345/346 | H4-/E47A/A142V/L242T/M294L | + |
| 421/422 | H4-/A142V/L242T/F290V/I373S/R374A | + |

[1]Levels of increased activity were determined relative to the reference polypeptide of SEQ ID NO: 4 and defined as follows: "+" 1.15 to 1.45, "++" > 1.45, "+++" > 2.50

All publications, patents, patent applications, and other documents cited in this application are hereby incorporated by reference in their entireties for all purposes to the same extent as if each individual publication, patent, patent application, or other document were individually indicated to be incorporated by reference for all purposes.

While various specific embodiments have been illustrated and described, it will be appreciated that various changes can be made without departing from the spirit and scope of the invention(s).

SEQUENCE LISTING (554 sequences)

SEQ ID NO: 1 - DNA, 1239 bp, Artificial Sequence
  WT acetate kinase from Thermotoga maritima with N-terminal His-tag
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 2 - protein, 413 aa, Artificial Sequence
  WT acetate kinase from Thermotoga maritima with N-terminal His-tag
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 3 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 4 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 5 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatttgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 6 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDLRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 7 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattggggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 8 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIGEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 9 - DNA, 1239 bp, Artificial Sequence
  Engineered variant of acetate kinase from Thermotoga maritima
atgggtagccatcatcatcatcatcacggtagccgtgttctgaatattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 10 - protein, 413 aa, Artificial Sequence
  Engineered variant of acetate kinase from Thermotoga maritima
MGSHHHHHHGSRVLNINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 11 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatatttctgaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 12 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDISEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 13 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgttttgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 14 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 15 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 16 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 17 - DNA, 1239 bp, Artificial Sequence
  Engineered variant of acetate kinase from Thermotoga maritima
atgggtagccatcatcatcatcatcacggtagccgtgttctggttattaatagcggtagcagcagccataaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 18 - protein, 413 aa, Artificial Sequence
  Engineered variant of acetate kinase from Thermotoga maritima
MGSHHHHHHGSRVLVINSGSSSHKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 19 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattggggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagtccgattacccgtgaagatgtttgtagctatctggaatttctgggtgttaaactggataaacagaaaaatgaagagaccattcgtggtaaacaaggtattattagcaccccggatagccgtgttaaagttctggttgttccgaccaatgaagaactgatgattgcacgtgataccaaagaaattgttgaaaaaatcggtcgt

SEQ ID NO: 20 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIGEAALKGDEWCKLVLEIYDYRIAKYIGAYAAAMNGVDAIVFTAGVGENSPITREDVCSYLEFLGVKLDKQKNEETIRGKQGIISTPDSRVKVLVVPTNEELMIARDTKEIVEKIGR

SEQ ID NO: 21 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccgacaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggtttggccgaccaatgaagaactgatgattgcacgtgataccaaagaaattgttgaaaaaatcggtcgt

SEQ ID NO: 22 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPTNLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVWPTNEELMIARDTKEIVEKIGR

SEQ ID NO: 23 - DNA, 1239 bp, Artificial Sequence
  Engineered variant of acetate kinase from Thermotoga maritima
atgggtagccatcatcatcatcatcacggtagcaaggttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaaagtgttgataccagcatgggttttaccccgctggaaggtctggttatgggtacccgtagcggtgatctggatccggcaattccattttttatcatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 24 - protein, 413 aa, Artificial Sequence
  Engineered variant of acetate kinase from Thermotoga maritima
MGSHHHHHHGSKVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 25 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattacggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 26 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDITEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 27 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtattagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 28 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGISHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 29 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccagcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaaagtgttgataccagcatgggttttaccccgctggaaggtctggttatgggtacccgtagcggtgatctggatccggcaattccattttttctgatggaaaaagagggtattagcccgcaggaaatgtatgatattctgaataaaaaaagcggcgttctgggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagcaaagttaaagttctggttgttccgaccaatgaagaactgatgattgcacgtgataccaaagaaattgttgaaaaaatcggtcgt

SEQ ID NO: 30 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPLEGLVMGTRSGDLDPAIPFFLMEKEGISPQEMYDILNKKSGVLGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSKVKVLVVPTNEELMIARDTKEIVEKIGR

SEQ ID NO: 31 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattagtggtaaagaaggtattattagcaccccggatagccgtgttaaagttctggttgttccgaccaatgaagaactgatgattgcacgtgataccaaagaaattgttgaaaaaatcggtcgt

SEQ ID NO: 32 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETISGKEGIISTPDSRVKVLVVPTNEELMIARDTKEIVEKIGR

SEQ ID NO: 33 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttctgatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 34 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFLMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 35 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttctgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 36 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVSENSPITREDVCSYLEFLGVKLDKQKNEETIRGKEGIISTPDSRVKVLVVPTNEELMIARDTKEIVEKIGR

SEQ ID NO: 37 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaagctattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 38 - protein, 413 aa, Artificial Sequence
  Engineered variant of acetate kinase from Thermotoga maritima
MGSHHHHHHGSRVLVINSGSSSIKYQLIEMEGEKVLCKAIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 39 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccgacaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgttacgggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 40 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPTNLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVTGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 41 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatggaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgttggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatggttgcacgtgataccaaagaaattgttgaaaaaatcggtcgt

SEQ ID NO: 42 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMELLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMVARDTKEIVEKIGR

SEQ ID NO: 43 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtatttttgaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 44 - protein, 413 aa, Artificial Sequence
  Engineered variant of acetate kinase from Thermotoga maritima
MGSHHHHHHGSRVLVINSGSSSIKYQLIEMEGEKVLCKGIFERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 45 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaaatcgataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 46 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKIDKQKNEETIRGKEGIISTPDSRVKVLVVPTNEELMIARDTKEIVEKIGR

SEQ ID NO: 47 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcctggtaaagaaggtattattagcaccccggatagccgtgttaaagttctggttgttccgaccaatgaagaactgatgattgcacgtgataccaaagaaattgttgaaaaaatcggtcgt

SEQ ID NO: 48 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIPGKEGIISTPDSRVKVLVVPTNEELMIARDTKEIVEKIGR

SEQ ID NO: 49 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattcttgaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccgaagaaattgttgaaaaaatcggtcgt

SEQ ID NO: 50 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDILEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTEEIVEKIGR

SEQ ID NO: 51 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatacgattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 52 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYTILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 53 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaaagtgttgataccagcatgggttttaccccgctggaaggtctggttatgggtacccgtagcggtgatctggatccggcaattccattttttatcatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 54 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 55 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcatggtaaagaaggtattattagcaccccggatagccgtgttaaagttctggttgttccgaccaatgaagaactgatgattgcacgtgataccaaagaaattgttgaaaaaatcggtcgt

SEQ ID NO: 56 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIHGKEGIISTPDSRVKVLVVPTNEELMIARDTKEIVEKIGR

SEQ ID NO: 57 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagctgattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 58 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEELIRGKEGIISTPDSRVKVLVVPTNEELMIARDTKEIVEKIGR

SEQ ID NO: 59 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggtttggccgaccaatgaagaactgatgattgcacgtgataccaaagaaattgttgaaaaaatcggtcgt

SEQ ID NO: 60 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVWPTNEELMIARDTKEIVEKIGR

SEQ ID NO: 61 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatcatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 62 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYHILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 63 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgataatgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 64 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDNEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 65 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagtgtattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 66 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEECIRGKEGIISTPDSRVKVLVVPTNEELMIARDTKEIVEKIGR

SEQ ID NO: 67 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagacccctcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 68 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETPRGKEGIISTPDSRVKVLVVPTNEELMIARDTKEIVEKIGR

SEQ ID NO: 69 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtgtggaaggtattattagcaccccggatagccgtgttaaagttctggttgttccgaccaatgaagaactgatgattgcacgtgataccaaagaaattgttgaaaaaatcggtcgt

SEQ ID NO: 70 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGVEGIISTPDSRVKVLVVPTNEELMIARDTKEIVEKIGR

SEQ ID NO: 71 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 72 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 73 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaggattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 74 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEERIRGKEGIISTPDSRVKVLVVPTNEELMIARDTKEIVEKIGR

SEQ ID NO: 75 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtcgtgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 76 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGREKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 77 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttatcatggaaaaagagggtattagcccgcaggaaatgtatgatattctgaataaaaaaagcggcgttctgggtctgagcaaaggttttagcagcgatatgcgtgatattgaagatgcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 78 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVLGLSKGFSSDMRDIEDAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 79 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttctgatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaaatcgataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 80 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFLMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKIDKQKNEETIRGKEGIISTPDSRVKVLVVPTNEELMIARDTKEIVEKIGR

SEQ ID NO: 81 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattgctggtaaagaaggtattattagcaccccggatagccgtgttaaagttctggttgttccgaccaatgaagaactgatgattgcacgtgataccaaagaaattgttgaaaaaatcggtcgt

SEQ ID NO: 82 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIAGKEGIISTPDSRVKVLVVPTNEELMIARDTKEIVEKIGR

SEQ ID NO: 83 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattctgggtaaagaaggtattattagcaccccggatagccgtgttaaagttctggttgttccgaccaatgaagaactgatgattgcacgtgataccaaagaaattgttgaaaaaatcggtcgt

SEQ ID NO: 84 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETILGKEGIISTPDSRVKVLVVPTNEELMIARDTKEIVEKIGR

SEQ ID NO: 85 - DNA, 1239 bp, Artificial Sequence
  Engineered variant of acetate kinase from Thermotoga maritima
atgggtagccatcatcatcatcatcacggtagcaaggttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccatgccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttatcatggaaaaagagggtattagcccgcaggaaatgtatgatattctgaataaaaaaagcggcgttctgggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 86 - protein, 413 aa, Artificial Sequence
  Engineered variant of acetate kinase from Thermotoga maritima
MGSHHHHHHGSKVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTMPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVLGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 87 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttctgatggaaaaagagggtattagcccgcaggaagtgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 88 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFLMEKEGISPQEVYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 89 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaagtgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 90 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEVYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 91 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccatttggggtaaagaaggtattattagcaccccggatagccgtgttaaagttctggttgttccgaccaatgaagaactgatgattgcacgtgataccaaagaaattgttgaaaaaatcggtcgt

SEQ ID NO: 92 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIWGKEGIISTPDSRVKVLVVPTNEELMIARDTKEIVEKIGR

SEQ ID NO: 93 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaatattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 94 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEENIRGKEGIISTPDSRVKVLVVPTNEELMIARDTKEIVEKIGR

SEQ ID NO: 95 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatacgctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 96 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYTLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 97 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgcaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 98 - protein, 413 aa, Artificial Sequence
  Engineered variant of acetate kinase from Thermotoga maritima
MGSHHHHHHGSRVLVINSGSSSIKYQLIEMEGEKVLCKGIAERIGIAGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 99 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccatgccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaaagtgttgataccagcatgggttttaccccgctggaaggtctggttatgggtacccgtagcggtgatctggatccggcaattccattttttctgatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagcaaagttaaagttctggttgttccgaccaatgaagaactgatgattgcacgtgataccaaagaaattgttgaaaaaatcggtcgt

SEQ ID NO: 100 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTMPQKAYLYAIPYEYYEKYKIRRYGFHGTSHRYVSKRAAEILGKKLEELKIITCHIGNGASVAAVKYGKSVDTSMGFTPLEGLVMGTRSGDLDPAIPFFLMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSKVKVLVVPTNEELMIARDTKEIVEKIGR

SEQ ID NO: 101 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatatttgggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 102 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIWEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 103 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctgggggttccgaccaatgaagaactgatgattgcacgtgataccaaagaaattgttgaaaaaatcggtcgt

SEQ ID NO: 104 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLGVPTNEELMIARDTKEIVEKIGR

SEQ ID NO: 105 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagctctggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 106 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSSGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 107 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcagtgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 108 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAVLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 109 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattatgggtaaagaaggtattattagcaccccggatagccgtgttaaagttctggttgttccgaccaatgaagaactgatgattgcacgtgataccaaagaaattgttgaaaaaatcggtcgt

SEQ ID NO: 110 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIMGKEGIISTPDSRVKVLVVPTNEELMIARDTKEIVEKIGR

SEQ ID NO: 111 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcagggtaaagaaggtattattagcaccccggatagccgtgttaaagttctggttgttccgaccaatgaagaactgatgattgcacgtgataccaaagaaattgttgaaaaaatcggtcgt

SEQ ID NO: 112 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIQGKEGIISTPDSRVKVLVVPTNEELMIARDTKEIVEKIGR

SEQ ID NO: 113 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtatttggggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 114 - protein, 413 aa, Artificial Sequence
  Engineered variant of acetate kinase from Thermotoga maritima
MGSHHHHHHGSRVLVINSGSSSIKYQLIEMEGEKVLCKGIAERIGIWGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 115 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtctgagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 116 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGLSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 117 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaaagtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagcaaagttaaagttctggttgttccgaccaatgaagaactgatgattgcacgtgataccaaagaaattgttgaaaaaatcggtcgt

SEQ ID NO: 118 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSKVKVLVVPTNEELMIARDTKEIVEKIGR

SEQ ID NO: 119 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtatttcgggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 120 - protein, 413 aa, Artificial Sequence
  Engineered variant of acetate kinase from Thermotoga maritima
MGSHHHHHHGSRVLVINSGSSSIKYQLIEMEGEKVLCKGIAERIGISGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 121 - DNA, 1239 bp, Artificial Sequence
  Engineered variant of acetate kinase from Thermotoga maritima
atgggtagccatcatcatcatcatcacggtagccgtgttctggttattaatagcggtagcagcagcaataaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 122 - protein, 413 aa, Artificial Sequence
  Engineered variant of acetate kinase from Thermotoga maritima
MGSHHHHHHGSRVLVINSGSSSNKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 123 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 124 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVCENSPITREDVCSYLEFLGVKLDKQKNEETIRGKEGIISTPDSRVKVLVVPTNEELMIARDTKEIVEKIGR

SEQ ID NO: 125 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcacgggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 126 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSTGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 127 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatgttgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 128 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHVVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 129 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaaagtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaaatcgataaacagaaaaatgaagagaccattcgtggtaaagaaggtattattagcaccccggatagcaaagttaaagttctggttgttccgaccaatgaagaactgatgattgcacgtgataccaaagaaattgttgaaaaaatcggtcgt

SEQ ID NO: 130 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKIDKQKNEETIRGKEGIISTPDSKVKVLVVPTNEELMIARDTKEIVEKIGR

SEQ ID NO: 131 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctgtggcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 132 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLWHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 133 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccatgccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttctgatggaaaaagagggtattagcccgcaggaaatgtatgatattctgaataaaaaaagcggcgttctgggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 134 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTMPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFLMEKEGISPQEMYDILNKKSGVLGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 135 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgttgaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 136 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIVEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 137 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagaggtgattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 138 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEEVIRGKEGIISTPDSRVKVLVVPTNEELMIARDTKEIVEKIGR

SEQ ID NO: 139 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcccggatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 140 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSPDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 141 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattcttgaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 142 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDILEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 143 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtagtgaaggtattattagcaccccggatagccgtgttaaagttctggttgttccgaccaatgaagaactgatgattgcacgtgataccaaagaaattgttgaaaaaatcggtcgt

SEQ ID NO: 144 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGSEGIISTPDSRVKVLVVPTNEELMIARDTKEIVEKIGR

SEQ ID NO: 145 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttctgatggaaaaagagggtattagcccgcaggaaatgtatgatattctgaataaaaaaagcggcgttctgggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaaatcgataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 146 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFLMEKEGISPQEMYDILNKKSGVLGLSKGFSSDMRDIEEAALKGDEWCKLVLEIYDYRIAKYIGAYAAAMNGVDAIVFTAGVGENSPITREDVCSYLEFLGVKIDKQKNEETIRGKEGIISTPDSRVKVLVVPTNEELMIARDTKEIVEKIGR

SEQ ID NO: 147 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatagtaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccgacaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 148 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDSKHVIERELPDHEEALKLILNTLVDEKLGVIKDLKEIDAVGHRVVHGGERFKESVLVDEEVLKAIEEVSPLAPLHNPTNLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 149 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaactattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 150 - protein, 413 aa, Artificial Sequence
  Engineered variant of acetate kinase from Thermotoga maritima
MGSHHHHHHGSRVLVINSGSSSIKYQLIEMEGEKVLCKTIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 151 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggttctgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccgacaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 152 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGSEKHVIERELPDHEEALKLILNTLVDEKLGVIKDLKEIDAVGHRVVHGGERFKESVLVDEEVLKAIEEVSPLAPLHNPTNLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 153 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctggggaatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 154 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLGNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 155 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagacctctcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 156 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETSRGKEGIISTPDSRVKVLVVPTNEELMIARDTKEIVEKIGR

SEQ ID NO: 157 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaaagtgttgataccagcatgggttttaccccgctggaaggtctggttatgggtacccgtagcggtgatctggatccggcaattgttttttttatcatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaaatcgataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 158 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPLEGLVMGTRSGDLDPAIVFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKIDKQKNEETIRGKEGIISTPDSRVKVLVVPTNEELMIARDTKEIVEKIGR

SEQ ID NO: 159 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaagtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 160 - protein, 413 aa, Artificial Sequence
  Engineered variant of acetate kinase from Thermotoga maritima
MGSHHHHHHGSRVLVINSGSSSIKYQLIEMEGEKVLCKSIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 161 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagaggggattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 162 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEEGIRGKEGIISTPDSRVKVLVVPTNEELMIARDTKEIVEKIGR

SEQ ID NO: 163 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccatgccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttatcatggaaaaagagggtattagcccgcaggaagtgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 164 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTMPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEVYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 165 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtgtgagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 166 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGVSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 167 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtggtggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 168 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGGGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 169 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattttgattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 170 - protein, 413 aa, Artificial Sequence
  Engineered variant of acetate kinase from Thermotoga maritima
MGSHHHHHHGSRVLVINSGSSSIKYQLIEMEGEKVLCKGIAERILIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 171 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttatcatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggctctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaaatcgataaacagaaaaatgaagagaccattcgtggtaaagaaggtattattagcaccccggatagcaaagttaaagttctggttgttccgaccaatgaagaactgatgattgcacgtgataccaaagaaattgttgaaaaaatcggtcgt

SEQ ID NO: 172 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLALEIYDYRIAKYIGAYAAAMNGVDAIVFTAGVGENSPITREDVCSYLEFLGVKIDKQKNEETIRGKEGIISTPDSKVKVLVVPTNEELMIARDTKEIVEKIGR

SEQ ID NO: 173 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatattgaagaagcagcactgaaaggtgatgaatggtgtaaactggctctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagcaaagttaaagttctggttgttccgaccaatgaagaactgatgattgcacgtgataccaaagaaattgttgaaaaaatcggtcgt

SEQ ID NO: 174 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVLGLSKGFSSDMRDIEEAALKGDEWCKLALEIYDYRIAKYIGAYAAAMNGVDAIVFTAGVGENSPITREDVCSYLEFLGVKLDKQKNEETIRGKEGIISTPDSKVKVLVVPTNEELMIARDTKEIVEKIGR

SEQ ID NO: 175 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgactaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 176 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLTKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 177 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttacggaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 178 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVTENSPITREDVCSYLEFLGVKLDKQKNEETIRGKEGIISTPDSRVKVLVVPTNEELMIARDTKEIVEKIGR

SEQ ID NO: 179 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaaagtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 180 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 181 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtcttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 182 - protein, 413 aa, Artificial Sequence; identical to SEQ ID NO: 116
  Engineered variant of acetate kinase from Thermotoga maritima

SEQ ID NO: 183 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttattcgctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 184 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYSLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 185 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgggggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 186 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTGGVGENSPITREDVCSYLEFLGVKLDKQKNEETIRGKEGIISTPDSRVKVLVVPTNEELMIARDTKEIVEKIGR

SEQ ID NO: 187 - DNA, 1239 bp, Artificial Sequence
  Engineered variant of acetate kinase from Thermotoga maritima
atgggtagccatcatcatcatcatcacggtagccgtgttctggcgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 188 - protein, 413 aa, Artificial Sequence
  Engineered variant of acetate kinase from Thermotoga maritima
MGSHHHHHHGSRVLAINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 189 - DNA, 1239 bp, Artificial Sequence
  Engineered variant of acetate kinase from Thermotoga maritima
atgggtagccatcatcatcatcatcacggtagccgtgttctgtcgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 190 - protein, 413 aa, Artificial Sequence
  Engineered variant of acetate kinase from Thermotoga maritima
MGSHHHHHHGSRVLSINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 191 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattcgtggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 192 - protein, 413 aa, Artificial Sequence
  Engineered variant of acetate kinase from Thermotoga maritima
MGSHHHHHHGSRVLVINSGSSSIKYQLIEMEGEKVLCKGIAERIGIRGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 193 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttatcatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 194 - protein, 413 aa, Artificial Sequence; identical to SEQ ID NO: 16
  Engineered variant of acetate kinase from Thermotoga maritima

SEQ ID NO: 195 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgattggaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 196 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDWKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 197 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtattttattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 198 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYFILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 199 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagccatggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 200 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSHGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 201 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgattttcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 202 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDFRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 203 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattaatggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 204 - protein, 413 aa, Artificial Sequence
  Engineered variant of acetate kinase from Thermotoga maritima
MGSHHHHHHGSRVLVINSGSSSIKYQLIEMEGEKVLCKGIAERIGINGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 205 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaatcttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 206 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKSFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 207 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctgtatatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 208 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLYMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 209 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttatcatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggctctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 210 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLALEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 211 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattatgggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 212 - protein, 413 aa, Artificial Sequence
  Engineered variant of acetate kinase from Thermotoga maritima
MGSHHHHHHGSRVLVINSGSSSIKYQLIEMEGEKVLCKGIAERIGIMGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 213 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtcgtagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 214 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGRSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 215 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataggaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 216 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNRKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 217 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagctcgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 218 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSSITREDVCSYLEFLGVKLDKQKNEETIRGKEGIISTPDSRVKVLVVPTNEELMIARDTKEIVEKIGR

SEQ ID NO: 219 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaaagtgttgataccagcatgggttttaccccgctggaaggtctggttatgggtacccgtagcggtgatctggatccggcaattccattttttatcatggaaaaagagggtattagcccgcaggaagtgtatgatattctgaataaaaaaagcggcgtttatggtctgagcaaaggttttagcagcgatatgcgtgatattgaagatgcagcactgaaaggtgatgaatggtgtaaactggctctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagcaaagttaaagttctggttgttccgaccaatgaagaactgatgattgcacgtgataccaaagaaattgttgaaaaaatcggtcgt

SEQ ID NO: 220 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPLEGLVMGTRSGDLDPAIPFFIMEKEGISPQEVYDILNKKSGVYGLSKGFSSDMRDIEDAALKGDEWCKLALEIYDYRIAKYIGAYAAAMNGVDAIVFTAGVGENSPITREDVCSYLEFLGVKLDKQKNEETIRGKEGIISTPDSKVKVLVVPTNEELMIARDTKEIVEKIGR

SEQ ID NO: 221 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccatgccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttatcatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagcaaagttaaagttctggttgttccgaccaatgaagaactgatgattgcacgtgataccaaagaaattgttgaaaaaatcggtcgt

SEQ ID NO: 222 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTMPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSKVKVLVVPTNEELMIARDTKEIVEKIGR

SEQ ID NO: 223 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgcttaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 224 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLLKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 225 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaatgggcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 226 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEWAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 227 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttcctccgaccaatgaagaactgatgattgcacgtgataccaaagaaattgttgaaaaaatcggtcgt

SEQ ID NO: 228 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVPPTNEELMIARDTKEIVEKIGR

SEQ ID NO: 229 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagaggatattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 230 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEEDIRGKEGIISTPDSRVKVLVVPTNEELMIARDTKEIVEKIGR

SEQ ID NO: 231 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagttgcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 232 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEVAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 233 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtcctaaagaaggtattattagcaccccggatagccgtgttaaagttctggttgttccgaccaatgaagaactgatgattgcacgtgataccaaagaaattgttgaaaaaatcggtcgt

SEQ ID NO: 234 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRPKEGIISTPDSRVKVLVVPTNEELMIARDTKEIVEKIGR

SEQ ID NO: 235 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttctgatggaaaaagagggtattagcccgcaggaaatgtatgatattctgaataaaaaaagcggcgttctgggtctgaccaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagcaaagttaaagttctggttgttccgaccaatgaagaactgatgattgcacgtgataccaaagaaattgttgaaaaaatcggtcgt

SEQ ID NO: 236 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFLMEKEGISPQEMYDILNKKSGVLGLTKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSKVKVLVVPTNEELMIARDTKEIVEKIGR

SEQ ID NO: 237 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtgtgggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 238 - protein, 413 aa, Artificial Sequence
  Engineered variant of acetate kinase from Thermotoga maritima
MGSHHHHHHGSRVLVINSGSSSIKYQLIEMEGEKVLCKGIAERVGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 239 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtatttggattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 240 - protein, 413 aa, Artificial Sequence
  Engineered variant of acetate kinase from Thermotoga maritima
MGSHHHHHHGSRVLVINSGSSSIKYQLIEMEGEKVLCKGIAERIWIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 241 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtattagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 242 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGISSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 243 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattcctggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 244 - protein, 413 aa, Artificial Sequence
  Engineered variant of acetate kinase from Thermotoga maritima
MGSHHHHHHGSRVLVINSGSSSIKYQLIEMEGEKVLCKGIAERIGIPGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 245 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctggggaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 246 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLGKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 247 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgttctggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 248 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRSGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 249 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagccgtggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 250 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSRGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 251 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctgcagatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 252 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLQMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 253 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattattggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 254 - protein, 413 aa, Artificial Sequence
  Engineered variant of acetate kinase from Thermotoga maritima
MGSHHHHHHGSRVLVINSGSSSIKYQLIEMEGEKVLCKGIAERIGIIGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 255 - DNA, 1239 bp, Artificial Sequence
  Engineered variant of acetate kinase from Thermotoga maritima
atgggtagccatcatcatcatcatcacggtagcaaggttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccatgccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttatcatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 256 - protein, 413 aa, Artificial Sequence
  Engineered variant of acetate kinase from Thermotoga maritima
MGSHHHHHHGSKVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTMPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 257 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttattcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 258 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVIRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 259 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgaataaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 260 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLNKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 261 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccatgccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttatcatggaaaaagagggtattagcccgcaggaaatgtatgatattctgaataaaaaaagcggcgtttatggtctgaccaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaaatcgataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 262 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTMPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLTKGFSSDMRDIEEAALKGDEWCKLVLEIYDYRIAKYIGAYAAAMNGVDAIVFTAGVGENSPITREDVCSYLEFLGVKIDKQKNEETIRGKEGIISTPDSRVKVLVVPTNEELMIARDTKEIVEKIGR

SEQ ID NO: 263 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgataataaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccgacaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 264 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDNKHVIERELPDHEEALKLILNTLVDEKLGVIKDLKEIDAVGHRVVHGGERFKESVLVDEEVLKAIEEVSPLAPLHNPTNLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 265 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtcatagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 266 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGHSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 267 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttatcatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagcaaagttaaagttctggttgttccgaccaatgaagaactgatgattgcacgtgataccaaagaaattgttgaaaaaatcggtcgt

SEQ ID NO: 268 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSKVKVLVVPTNEELMIARDTKEIVEKIGR

SEQ ID NO: 269 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtattcgattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 270 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYSILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 271 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcatgtatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 272 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGMYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 273 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtgttagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 274 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGVSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 275 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccatgccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaaagtgttgataccagcatgggttttaccccgctggaaggtctggttatgggtacccgtagcggtgatctggatccggcaattccattttttatcatggaaaaagagggtattagcccgcaggaaatgtatgatattctgaataaaaaaagcggcgttctgggtctgaccaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 276 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTMPQKAYLYAIPYEYYEKYKIRRYGFHGTSHRYVSKRAAEILGKKLEELKIITCHIGNGASVAAVKYGKSVDTSMGFTPLEGLVMGTRSGDLDPAIPFFIMEKEGISPQEMYDILNKKSGVLGLTKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 277 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttacggaaaatagcccgattacccgtgaagatgtttgtagctatctggaatttctgggtgttaaactggataaacagaaaaatgaagagaccattcgtggtaaagaaggtattattagcaccccggatagccgtgttatagttctggttgttccgaccaatgaagaactgatgattgcacgtgataccaaagaaattgttgaaaaaatcggtcgt

SEQ ID NO: 278 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVTENSPITREDVCSYLEFLGVKLDKQKNEETIRGKEGIISTPDSRVIVLVVPTNEELMIARDTKEIVEKIGR

SEQ ID NO: 279 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccatgccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 280 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTMPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 281 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtagtggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttgtgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 282 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGSGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFVGVKLDKQKNEETIRGKEGIISTPDSRVKVLVVPTNEELMIARDTKEIVEKIGR

SEQ ID NO: 283 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgttggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccgaagaaattgttgaaaaaatcggtcgt

SEQ ID NO: 284 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTEEIVEKIGR

SEQ ID NO: 285 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaacaggcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 286 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEQAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 287 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcattattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 288 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSIITREDVCSYLEFLGVKLDKQKNEETIRGKEGIISTPDSRVKVLVVPTNEELMIARDTKEIVEKIGR

SEQ ID NO: 289 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttctgatggaaaaagagggtattagcccgcaggaaatgtatgatattctgaataaaaaaagcggcgtttatggtctgaccaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 290 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFLMEKEGISPQEMYDILNKKSGVYGLTKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 291 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaaatcgataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 292 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKIDKQKNEETIRGKEGIISTPDSRVKVLVVPTNEELMIARDTKEIVEKIGR

SEQ ID NO: 293 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattagtggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaattcggtcgt

SEQ ID NO: 294 - protein, 413 aa, Artificial Sequence
  Engineered variant of acetate kinase from Thermotoga maritima
MGSHHHHHHGSRVLVINSGSSSIKYQLIEMEGEKVLCKGIAERIGISGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKFGR

SEQ ID NO: 295 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccagctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 296 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSQLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 297 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaaagtgttgataccagcatgggttttaccccgctggaaggtctggttatgggtacccgtagcggtgatctggatccggcaattccattttttctgatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 298 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPLEGLVMGTRSGDLDPAIPFFLMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 299 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatacgattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 300 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHTIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 301 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagccagattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 302 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSQITREDVCSYLEFLGVKLDKQKNEETIRGKEGIISTPDSRVKVLVVPTNEELMIARDTKEIVEKIGR

SEQ ID NO: 303 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaacgtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 304 - protein, 413 aa, Artificial Sequence
  Engineered variant of acetate kinase from Thermotoga maritima
MGSHHHHHHGSRVLVINSGSSSIKYQLIEMEGEKVLCKGIAERIGIERSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 305 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccatgccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttctgatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 306 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKAAMKLLPGVPNVAVFDTAFHQTMPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFLMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 307 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcacctctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatgatgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 308 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNDVDAIVFTAGVGENSPITREDVCSYLEFLGVKLDKQKNEETIRGKEGIISTPDSRVKVLVVPTNEELMIARDTKEIVEKIGR

SEQ ID NO: 309 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtattatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 310 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYYILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 311 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccacgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 312 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTTLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 313 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagccgtgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 314 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSRDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 315 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacattcgattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 316 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHSIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 317 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagatgcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagcaaagttaaagttctggttgttccgaccaatgaagaactgatgattgcacgtgataccaaagaaattgttgaaaaaatcggtcgt

SEQ ID NO: 318 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEDAALKGDEWCKLVLEIYDYRIAKYIGAYAAAMNGVDAIVFTAGVGENSPITREDVCSYLEFLGVKLDKQKNEETIRGKEGIISTPDSKVKVLVVPTNEELMIARDTKEIVEKIGR

SEQ ID NO: 319 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaagtgtatgatattctgaataaaaaaagcggcgtttatggtctgagcaaaggttttagcagcgatatgcgtgatattgaagaagcagcactgaaaggtgatgaatggtgtaaactggctctggacatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaaatcgataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 320 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEVYDILNKKSGVYGLSKGFSSDMRDIEEAALKGDEWCKLALDIYDYRIAKYIGAYAAAMNGVDAIVFTAGVGENSPITREDVCSYLEFLGVKIDKQKNEETIRGKEGIISTPDSRVKVLVVPTNEELMIARDTKEIVEKIGR

SEQ ID NO: 321 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttgaggaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 322 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVEENSPITREDVCSYLEFLGVKLDKQKNEETIRGKEGIISTPDSRVKVLVVPTNEELMIARDTKEIVEKIGR

SEQ ID NO: 323 - DNA, 1239 bp, Artificial Sequence
  Engineered variant of acetate kinase from Thermotoga maritima
atgggtagccatcatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggtcgatgaagaagttctgaaagcaattgaagaagttagcccgctggcaccgctgcataatccggcaaatctgatgggtattaaagcagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaactgaaaattatcacctgtcatattggtaatggtgcaagcgttgcagcagttaaatatggtaaatgtgttgataccagcatgggttttaccccgctggaaggtctggttatgggtacccgtagcggtgatctggatccggcaattccattttttctgatggaaaaagagggtattagcccgcaggaaatgtatgatattctgaataaaaaaagcggcgttctgggtctgaccaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 324 - protein, 413 aa, Artificial Sequence
  Engineered variant of acetate kinase from Thermotoga maritima
MGSHHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKAAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPLEGLVMGTRSGDLDPAIPFFLMEKEGISPQEMYDILNKKSGVLGLTKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 325 - DNA, 1236 bp, Artificial Sequence
  Engineered variant of acetate kinase from Thermotoga maritima
atgggtagccatcatcatcatcacggtagccgtgttctggttattaatagcggtagcagcagcatcaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatgtgggggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 326 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDVGEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 327 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaaagcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 328 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPTEGLVMGTRSGDLDPAIPFFIMEKEGISPQEMYDILNKKSGVYGLSKGFSSDLRDVEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 329 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgagggtagccgtctggttcatcgtgttggtgatgaaaaacatgttattgaacgtgaactgccggatcatgaagaagcactgaaactgatcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatagtctgagcaaaggttttagcagcgatctgcgtgatattgaagaagcagcactgaaaggtgatgaatggtgtaaactggcgctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagagggcattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 330 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYSLSKGFSSDLRDIEEAALKGDEWCKLALEIYDYRIAKYIGAYAAAMNGVDAIVFTAGVTENSPITREDVCSYLEFLGVKLDKQKNEEGIRGKEGIISTPDSRVKVLVVPTNEELMIARDTKEIVEKIGR

SEQ ID NO: 331 - DNA, 1236 bp, Artificial Sequence
  Engineered variant of acetate kinase from Thermotoga maritima
atgggtagccatcatcatcatcacggtagccgtgttctggttattaatagcggtagcagcagcatcaaatatcagctgattgaaatggaaggtgaaaaagttctgtgtaaaggtattgcagaacgtattggtattgaaggtagccgttttgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatctgcgtgatattgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 332 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDLRDIEEAALKGDEWCKLVLEIYDYRIAKYIGAYAAAMNGVDAIVFTAGVCENSPITREDVCSYLEFLGVKLDKQKNEETIDGKEGIISTPDSRVKVLVVPTNEELMIARDTKEIVEKIGR

SEQ ID NO: 333 - DNA, 1236 bp, Artificial Sequence
  Engineered variant of acetate kinase from Thermotoga maritima
atgggtagccatcatcatcatcacggtagccgtgttctggttattaatagcggtagcagcagcatcaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatattgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 334 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDIEEAALKGDEWCKLVLEIYDYRIAKYIGAYAAAMNGVDAIVFTAGVCENSPITREDVCSYLEFLGVKLDKQKNEETIDGKEGIISTPDSRVKVLVVPTNEELMIARDTKEIVEKIGR

SEQ ID NO: 335 - DNA, 1236 bp, Artificial Sequence
  Engineered variant of acetate kinase from Thermotoga maritima
atgggtagccatcatcatcatcacggtagccgtgttctggtgattaatagcggtagcagcagccataaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatctgcgtgatagtgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 336 - protein, 412 aa, Artificial Sequence
  Engineered variant of acetate kinase from Thermotoga maritima
MGSHHHHHGSRVLVINSGSSSHKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDLRDSEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 337 - DNA, 1236 bp, Artificial Sequence
  Engineered variant of acetate kinase from Thermotoga maritima
atgggtagccatcatcatcatcacggtagccgtgttctggtgattaatagcggtagcagcagcatcaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 338 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDVEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 339 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 340 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDVEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 341 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatagtctgagcaaaggttttagcagcgatctgcgtgatattgaagaagcagcactgaaaggtgatgaatggtgtaaactggtgctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagacgattcgtggtaaagaaggtattattagcaccccggatagccgtgttaaagttctgggtccgccgaccaatgaagaactgatgattgcacgtgataccaaagaaattgttgaaaaaatcggtcgt

SEQ ID NO: 342 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYSLSKGFSSDLRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLGPPTNEELMIARDTKEIVEKIGR

SEQ ID NO: 343 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgagggtagccgtctggttcatcgtgttggtgatgaaaaacatgttattgaacgtgaactgccggatcatgaagaagcactgaaactggtcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatattgaagaagcagcactgaaaggtgatgaatggtgtaaactggtgctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagacgattcgtggtaaagaaggtattattagcaccccggatagccgtgttaaagttctggttccgccgaccaatgaagaactgatgattgcacgtgataccaaagaaattgttgaaaaaatcggtcgt

SEQ ID NO: 344 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVPPTNEELMIARDTKEIVEKIGR

SEQ ID NO: 345 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgcaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 346 - protein, 412 aa, Artificial Sequence
  Engineered variant of acetate kinase from Thermotoga maritima
MGSHHHHHGSRVLVINSGSSSIKYQLIEMEGEKVLCKGIAERIGIAGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 347 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagaggacattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 348 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDIEEAALKGDEWCKLVLEIYDYRIAKYIGAYAAAMNGVDAIVFTAGVGENSPITREDVCSYLEFLGVKLDKQKNEEDIRGKEGIISTPDSRVKVLVVPTNEELMIARDTKEIVEKIGR

SEQ ID NO: 349 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatctgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 350 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDLRDVEEAALKGDEWCKLVLEIYDYRIAKYIGAYAAAMNGVDAIVFTAGVCENSPITREDVCSYLEFLGVKLDKQKNEETIRGKEGIISTPDSRVKVLVVPTNEELMIARDTKEIVEKIGR

SEQ ID NO: 351 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 352 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDVEEAALKGDEWCKLVLEIYDYRIAKYIGAYAAAMNGVDAIVFTAGVCENSPITREDVCSYLEFLGVKLDKQKNEETIDGKEGIISTPDSRVKVLVVPTNEELMIARDTKEIVEKIGR

SEQ ID NO: 353 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatattgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 354 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 355 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgagcgtagccgtctggttcatcgtgttggtgatgaaaaacatgttattgaacgtgaactgccggatcatgaagaagcactgaaactgatcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatattgaagaagcagcactgaaaggtgatgaatggtgtaaactggcgctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagaggacattcgtggtaaagaaggtattattagcaccccggatagccgtgttaaagttctggttgtgccgaccaatgaagaactgatgattgcacgtgataccaaagaaattgttgaaaaaatcggtcgt

SEQ ID NO: 356 - protein, 412 aa, Artificial Sequence
  Engineered variant of acetate kinase from Thermotoga maritima
MGSHHHHHGSRVLVINSGSSSIKYQLIEMEGEKVLCKGIAERIGIERSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDIEEAALKGDEWCKLALEIYDYRIAKYIGAYAAAMNGVDAIVFTAGVGENSPITREDVCSYLEFLGVKLDKQKNEEDIRGKEGIISTPDSRVKVLVVPTNEELMIARDTKEIVEKIGR

SEQ ID NO: 357 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaaagcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 358 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVCENSPITREDVCSYLEFLGVKLDKQKNEETIDGKEGIISTPDSRVKVLVVPTNEELMIARDTKEIVEKIGR

SEQ ID NO: 359 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 360 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDIEEAALKGDEWCKLVLEIYDYRIAKYIGAYAAAMNGVDAIVFTAGVCENSPITREDVCSYLEFLGVKLDKQKNEETIRGKEGIISTPDSRVKVLVVPTNEELMIARDTKEIVEKIGR

SEQ ID NO: 361 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgttttgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 362 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDVEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 363 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagacgattcgtggtaaagaaggtattattagcaccccggatagccgtgttaaagttctgggtgtgccgaccaatgaagaactgatgattgcacgtgataccaaagaaattgttgaaaaaatcggtcgt

SEQ ID NO: 364 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLGVPTNEELMIARDTKEIVEKIGR

SEQ ID NO: 365 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 366 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDVEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 367 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatagtgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 368 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDSEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 369 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgagcgtagccgtctggttcatcgtgttggtgatgaaaaacatgttattgaacgtgaactgccggatcatgaagaagcactgaaactgatcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatagtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagggcattcgtggtaaagaaggtattattagcaccccggatagccgtgttaaagttctggttccgccgaccaatgaagaactgatgattgcacgtgataccaaagaaattgttgaaaaaatcggtcgt

SEQ ID NO: 370 - protein, 412 aa, Artificial Sequence
  Engineered variant of acetate kinase from Thermotoga maritima
MGSHHHHHGSRVLVINSGSSSIKYQLIEMEGEKVLCKGIAERIGIERSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYSLSKGFSSDMRDIEEAALKGDEWCKLVLEIYDYRIAKYIGAYAAAMNGVDAIVFTAGVGENSPITREDVCSYLEFLGVKLDKQKNEEGIRGKEGIISTPDSRVKVLVPPTNEELMIARDTKEIVEKIGR

SEQ ID NO: 371 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgagggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatcctgcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagaggacattcgtggtaaagaaggtattattagcaccccggatagccgtgttaaagttctggttccgccgaccaatgaagaactgatgattgcacgtgataccaaagaaattgttgaaaaaatcggtcgt

SEQ ID NO: 372 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVTENSPITREDVCSYLEFLGVKLDKQKNEEDIRGKEGIISTPDSRVKVLVPPTNEELMIARDTKEIVEKIGR

SEQ ID NO: 373 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatctgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 374 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDLRDVEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 375 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgttttgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaaagcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatattgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 376 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPTEGLVMGTRSGDLDPAIPFFIMEKEGISPQEMYDILNKKSGVLGLSKGFSSDMRDIEEAALKGDEWCKLVLEIYDYRIAKYIGAYAAAMNGVDAIVFTAGVCENSPITREDVCSYLEFLGVKLDKQKNEETIRGKEGIISTPDSRVKVLVVPTNEELMIARDTKEIVEKIGR

SEQ ID NO: 377 - DNA, 1236 bp, Artificial Sequence
  Engineered variant of acetate kinase from Thermotoga maritima
atgggtagccatcatcatcatcacggtagccgtgttctggtgattaatagcggtagcagcagcatcaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 378 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVCENSPITREDVCSYLEFLGVKLDKQKNEETIRGKEGIISTPDSRVKVLVVPTNEELMIARDTKEIVEKIGR

SEQ ID NO: 379 - DNA, 1236 bp, Artificial Sequence
  Engineered variant of acetate kinase from Thermotoga maritima
atgggtagccatcatcatcatcacggtagccgtgttctggttattaatagcggtagcagcagcatcaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatgtgggggaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 380 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDMRDVGEAALKGDEWCKLVLEIYDYRIAKYIGAYAAAMNGVDAIVFTAGVCENSPITREDVCSYLEFLGVKLDKQKNEETIRGKEGIISTPDSRVKVLVVPTNEELMIARDTKEIVEKIGR

SEQ ID NO: 381 - DNA, 1236 bp, Artificial Sequence
  Engineered variant of acetate kinase from Thermotoga maritima
atgggtagccatcatcatcatcacggtagccgtgttctggttattaatagcggtagcagcagcatcaaatatcagctgattgaaatggaaggtgaaaaagttctgtgtaaaggtattgcagaacgtattggtattgcaggtagccgttttgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 382 - protein, 412 aa, Artificial Sequence
  Engineered variant of acetate kinase from Thermotoga maritima
MGSHHHHHGSRVLVINSGSSSIKYQLIEMEGEKVLCKGIAERIGIAGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDVEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 383 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggtcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagagggcattcgtggtaaagaaggtattattagcaccccggatagccgtgttaaagttctggttgtgccgaccaatgaagaactgatgattgcacgtgataccaaagaaattgttgaaaaaatcggtcgt

SEQ ID NO: 384 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVTENSPITREDVCSYLEFLGVKLDKQKNEEGIRGKEGIISTPDSRVKVLVVPTNEELMIARDTKEIVEKIGR

SEQ ID NO: 385 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgagcgtagccgtctggttcatcgtgttggtgatgaaaaacatgttattgaacgtgaactgccggatcatgaagaagcactgaaactgatcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttccgccgaccaatgaagaactgatgattgcacgtgataccaaagaaattgttgaaaaaatcggtcgt

SEQ ID NO: 386 - protein, 412 aa, Artificial Sequence
  Engineered variant of acetate kinase from Thermotoga maritima
MGSHHHHHGSRVLVINSGSSSIKYQLIEMEGEKVLCKGIAERIGIERSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVTENSPITREDVCSYLEFLGVKLDKQKNEETIRGKEGIISTPDSRVKVLVPPTNEELMIARDTKEIVEKIGR

SEQ ID NO: 387 - DNA, 1236 bp, Artificial Sequence
  Engineered variant of acetate kinase from Thermotoga maritima
atgggtagccatcatcatcatcacggtagccgtgttctggtgattaatagcggtagcagcagcatcaaatatcagctgattgaaatggaaggtgaaaaagttctgtgtaaaggtattgcagaacgtattggtattgaaggtagccgttttgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatctgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 388 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDLRDVEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 389 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattagccgtagccgtctggttcatcgtgttggtgatgaaaaacatgttattgaacgtgaactgccggatcatgaagaagcactgaaactgatcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatagtctgagcaaaggttttagcagcgatctgcgtgatattgaagaagcagcactgaaaggtgatgaatggtgtaaactggtgctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgtgccgaccaatgaagaactgatgattgcacgtgataccaaagaaattgttgaaaaaatcggtcgt

SEQ ID NO: 390 - protein, 412 aa, Artificial Sequence
  Engineered variant of acetate kinase from Thermotoga maritima
MGSHHHHHGSRVLVINSGSSSIKYQLIEMEGEKVLCKGIAERIGISRSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYSLSKGFSSDLRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 391 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgagcgtagccgtctggttcatcgtgttggtgatgaaaaacatgttattgaacgtgaactgccggatcatgaagaagcactgaaactggtcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatagtctgagcaaaggttttagcagcgatctgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagggcattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 392 - protein, 412 aa, Artificial Sequence
  Engineered variant of acetate kinase from Thermotoga maritima
MGSHHHHHGSRVLVINSGSSSIKYQLIEMEGEKVLCKGIAERIGIERSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYSLSKGFSSDLRDIEEAALKGDEWCKLVLEIYDYRIAKYIGAYAAAMNGVDAIVFTAGVGENSPITREDVCSYLEFLGVKLDKQKNEEGIRGKEGIISTPDSRVKVLVVPTNEELMIARDTKEIVEKIGR

SEQ ID NO: 393 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagggcattcgtggtaaagaaggtattattagcaccccggatagccgtgttaaagttctgggtgtgccgaccaatgaagaactgatgattgcacgtgataccaaagaaattgttgaaaaaatcggtcgt

SEQ ID NO: 394 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEEGIRGKEGIISTPDSRVKVLGVPTNEELMIARDTKEIVEKIGR

SEQ ID NO: 395 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgatcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatactctgagcaaaggttttagcagcgatctgcgtgatattgaagaagcagcactgaaaggtgatgaatggtgtaaactggtgctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctgggtgtgccgaccaatgaagaactgatgattgcacgtgataccaaagaaattgttgaaaaaatcggtcgt

SEQ ID NO: 396 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYTLSKGFSSDLRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLGVPTNEELMIARDTKEIVEKIGR

SEQ ID NO: 397 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatactctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagaggacattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 398 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYTLSKGFSSDMRDIEEAALKGDEWCKLVLEIYDYRIAKYIGAYAAAMNGVDAIVFTAGVTENSPITREDVCSYLEFLGVKLDKQKNEEDIRGKEGIISTPDSRVKVLVVPTNEELMIARDTKEIVEKIGR

SEQ ID NO: 399 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 400 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDMRDVEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 401 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatgtgggggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 402 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDVGEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 403 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatccggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 404 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDMRDIEEAALKGDEWCKLVLEIYDYRIAKYIGAYAAAMNGVDAIVFTAGVGENSPITREDVCSYPEFLGVKLDKQKNEETIRGKEGIISTPDSRVKVLVVPTNEELMIARDTKEIVEKIGR

SEQ ID NO: 405 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgcaggtagccgttttgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatgtgggggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 406 - protein, 412 aa, Artificial Sequence
  Engineered variant of acetate kinase from Thermotoga maritima
MGSHHHHHGSRVLVINSGSSSIKYQLIEMEGEKVLCKGIAERIGIAGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDMRDVGEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 407 - DNA, 1236 bp, Artificial Sequence
  Engineered variant of acetate kinase from Thermotoga maritima
atgggtagccatcatcatcatcacggtagccgtgttctggttattaatagcggtagcagcagcatcaaatatcagctgattgaaatggaaggtgaaaaagttctgtgtaaaggtattgcagaacgtattggtattgaaggtagccgttttgttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 408 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 409 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggtgctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagacgattcgtggtaaagaaggtattattagcaccccggatagccgtgttaaagttctgggtccgccgaccaatgaagaactgatgattgcacgtgataccaaagaaattgttgaaaaaatcggtcgt

SEQ ID NO: 410 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLGPPTNEELMIARDTKEIVEKIGR

SEQ ID NO: 411 - DNA, 1236 bp, Artificial Sequence
  Engineered variant of acetate kinase from Thermotoga maritima
atgggtagccatcatcatcatcacggtagccgtgttctgaacattaatagcggtagcagcagcattaaatatcagctgattgaaatggaaggtgaaaaagttctgtgtaaaggtattgcagaacgtattggtattgagggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatactctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagaggacattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 412 - protein, 412 aa, Artificial Sequence
  Engineered variant of acetate kinase from Thermotoga maritima
MGSHHHHHGSRVLNINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYTLSKGFSSDMRDIEEAALKGDEWCKLVLEIYDYRIAKYIGAYAAAMNGVDAIVFTAGVGENSPITREDVCSYLEFLGVKLDKQKNEEDIRGKEGIISTPDSRVKVLVVPTNEELMIARDTKEIVEKIGR

SEQ ID NO: 413 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatagtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagaggacattcgtggtaaagaaggtattattagcaccccggatagccgtgttaaagttctggttgtgccgaccaatgaagaactgatgattgcacgtgataccaaagaaattgttgaaaaaatcggtcgt

SEQ ID NO: 414 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYSLSKGFSSDMRDIEEAALKGDEWCKLVLEIYDYRIAKYIGAYAAAMNGVDAIVFTAGVTENSPITREDVCSYLEFLGVKLDKQKNEEDIRGKEGIISTPDSRVKVLVVPTNEELMIARDTKEIVEKIGR

SEQ ID NO: 415 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgagggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagggcattcgtggtaaagaaggtattattagcaccccggatagccgtgttaaagttctggttgtgccgaccaatgaagaactgatgattgcacgtgataccaaagaaattgttgaaaaaatcggtcgt

SEQ ID NO: 416 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEEGIRGKEGIISTPDSRVKVLVVPTNEELMIARDTKEIVEKIGR

SEQ ID NO: 417 - DNA, 1236 bp, Artificial Sequence
  Engineered variant of acetate kinase from Thermotoga maritima
atgggtagccatcatcatcatcacggtagccgtgttctgaacattaatagcggtagcagcagcattaaatatcagctgattgaaatggaaggtgaaaaagttctgtgtaaaggtattgcagaacgtattggtattgaaggtagccgttttgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaaagcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatagtgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 418 - protein, 412 aa, Artificial Sequence
  Engineered variant of acetate kinase from Thermotoga maritima
MGSHHHHHGSRVLNINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPTEGLVMGTRSGDLDPAIPFFIMEKEGISPQEMYDILNKKSGVLGLSKGFSSDMRDSEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 419 - DNA, 1236 bp, Artificial Sequence
  Engineered variant of acetate kinase from Thermotoga maritima
atgggtagccatcatcatcatcacggtagccgtgttctggttattaatagcggtagcagcagcatcaaatatcagctgattgaaatggaaggtgaaaaagttctgtgtaaaggtattgcagaacgtattggtattgcaggtagccgttttgttcatcgtgctggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 420 - protein, 412 aa, Artificial Sequence
  Engineered variant of acetate kinase from Thermotoga maritima
MGSHHHHHGSRVLVINSGSSSIKYQLIEMEGEKVLCKGIAERIGIAGSRFVHRAGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVCENSPITREDVCSYLEFLGVKLDKQKNEETIDGKEGIISTPDSRVKVLVVPTNEELMIARDTKEIVEKIGR

SEQ ID NO: 421 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcacaatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtactagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtgttagctcggatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccagcgctggtaaagaaggtattattagcaccccggatagccgtgttaaagttctggttgttccgaccaatgaagaactgatgattgcacgtgataccaaagaaattgttgaaaaaatcggtcgt

SEQ ID NO: 422 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGVSSDMRDIEEAALKGDEWCKLVLEIYDYRIAKYIGAYAAAMNGVDAIVFTAGVGENSPITREDVCSYLEFLGVKLDKQKNEETSAGKEGIISTPDSRVKVLVVPTNEELMIARDTKEIVEKIGR

SEQ ID NO: 423 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaaagcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 424 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPTEGLVMGTRSGDLDPAIPFFIMEKEGISPQEMYDILNKKSGVYGLSKGFSSDMRDVEEAALKGDEWCKLVLEIYDYRIAKYIGAYAAAMNGVDAIVFTAGVCENSPITREDVCSYLEFLGVKLDKQKNEETIRGKEGIISTPDSRVKVLVVPTNEELMIARDTKEIVEKIGR

SEQ ID NO: 425 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattagccgtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatagtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttccgccgaccaatgaagaactgatgattgcacgtgataccaaagaaattgttgaaaaaatcggtcgt

SEQ ID NO: 426 - protein, 412 aa, Artificial Sequence
  Engineered variant of acetate kinase from Thermotoga maritima
MGSHHHHHGSRVLVINSGSSSIKYQLIEMEGEKVLCKGIAERIGISRSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYSLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVPPTNEELMIARDTKEIVEKIGR

SEQ ID NO: 427 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatagtgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 428 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDMRDSEEAALKGDEWCKLVLEIYDYRIAKYIGAYAAAMNGVDAIVFTAGVCENSPITREDVCSYLEFLGVKLDKQKNEETIDGKEGIISTPDSRVKVLVVPTNEELMIARDTKEIVEKIGR

SEQ ID NO: 429 - DNA, 1236 bp, Artificial Sequence
  Engineered variant of acetate kinase from Thermotoga maritima
atgggtagccatcatcatcatcacggtagccgtgttctggttattaatagcggtagcagcagccataaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatagtgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 430 - protein, 412 aa, Artificial Sequence
  Engineered variant of acetate kinase from Thermotoga maritima
MGSHHHHHGSRVLVINSGSSSHKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDSEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 431 - DNA, 1236 bp, Artificial Sequence
  Engineered variant of acetate kinase from Thermotoga maritima
atgggtagccatcatcatcatcacggtagccgtgttctggttattaatagcggtagcagcagccataaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 432 - protein, 412 aa, Artificial Sequence
  Engineered variant of acetate kinase from Thermotoga maritima
MGSHHHHHGSRVLVINSGSSSHKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDVEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 433 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 434 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDVEEAALKGDEWCKLVLEIYDYRIAKYIGAYAAAMNGVDAIVFTAGVCENSPITREDVCSYLEFLGVKLDKQKNEETIRGKEGIISTPDSRVKVLVVPTNEELMIARDTKEIVEKIGR

SEQ ID NO: 435 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggtcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggtgctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagaggacattcgtggtaaagaaggtattattagcaccccggatagccgtgttaaagttctggttgtgccgaccaatgaagaactgatgattgcacgtgataccaaagaaattgttgaaaaaatcggtcgt

SEQ ID NO: 436 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVTENSPITREDVCSYLEFLGVKLDKQKNEEDIRGKEGIISTPDSRVKVLVVPTNEELMIARDTKEIVEKIGR

SEQ ID NO: 437 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgttttgttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatctgcgtgatactgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 438 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDLRDTEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 439 - DNA, 1236 bp, Artificial Sequence
  Engineered variant of acetate kinase from Thermotoga maritima
atgggtagccatcatcatcatcacggtagccgtgttctgaacattaatagcggtagcagcagcatcaaatatcagctgattgaaatggaaggtgaaaaagttctgtgtaaaggtattgcagaacgtattggtattgcaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 440 - protein, 412 aa, Artificial Sequence
  Engineered variant of acetate kinase from Thermotoga maritima
MGSHHHHHGSRVLNINSGSSSIKYQLIEMEGEKVLCKGIAERIGIAGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDVEEAALKGDEWCKLVLEIYDYRIAKYIGAYAAAMNGVDAIVFTAGVCENSPITREDVCSYLEFLGVKLDKQKNEETIRGKEGIISTPDSRVKVLVVPTNEELMIARDTKEIVEKIGR

SEQ ID NO: 441 - DNA, 1236 bp, Artificial Sequence
  Engineered variant of acetate kinase from Thermotoga maritima
atgggtagccatcatcatcatcacggtagccgtgttctggttattaatagcggtagcagcagccataaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaaagcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 442 - protein, 412 aa, Artificial Sequence
  Engineered variant of acetate kinase from Thermotoga maritima
MGSHHHHHGSRVLVINSGSSSHKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPTEGLVMGTRSGDLDPAIPFFIMEKEGISPQEMYDILNKKSGVLGLSKGFSSDMRDIEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 443 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatactctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagagacgattcgtggtaaagaaggtattattagcaccccggatagccgtgttaaagttctgggtgtgccgaccaatgaagaactgatgattgcacgtgataccaaagaaattgttgaaaaaatcggtcgt

SEQ ID NO: 444 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYTLSKGFSSDMRDIEEAALKGDEWCKLVLEIYDYRIAKYIGAYAAAMNGVDAIVFTAGVTENSPITREDVCSYLEFLGVKLDKQKNEETIRGKEGIISTPDSRVKVLGVPTNEELMIARDTKEIVEKIGR

SEQ ID NO: 445 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgcaggtagccgttttgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatattggggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 446 - protein, 412 aa, Artificial Sequence
  Engineered variant of acetate kinase from Thermotoga maritima
MGSHHHHHGSRVLVINSGSSSIKYQLIEMEGEKVLCKGIAERIGIAGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDIGEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 447 - DNA, 1236 bp, Artificial Sequence
  Engineered variant of acetate kinase from Thermotoga maritima
atgggtagccatcatcatcatcacggtagccgtgttctgaacattaatagcggtagcagcagcatcaaatatcagctgattgaaatggaaggtgaaaaagttctgtgtaaaggtattgcagaacgtattggtattgcaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatattgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 448 - protein, 412 aa, Artificial Sequence
  Engineered variant of acetate kinase from Thermotoga maritima
MGSHHHHHGSRVLNINSGSSSIKYQLIEMEGEKVLCKGIAERIGIAGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 449 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcacaatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtactagccatcgttatgttagcaaacgtgcagcagaaattctgggtaaaaaactggaagaattgaaaattatcacctgtcatattggtaacggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtcgtagctcggatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgccggtgttggtgaaaatagcccgattacccgtgaagatgtttgtagctatctggaatttctgggtgttaaactggataaacagaaaaatgaagagaccccacctggtaaagaaggtattattagcaccccggatagccgtgttaaagttctggttgttccgaccaatgaagaactgatgattgcacgtgataccaaagaaattgttgaaaaaatcggtcgt

SEQ ID NO: 450 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGRSSDMRDIEEAALKGDEWCKLVLEIYDYRIAKYIGAYAAAMNGVDAIVFTAGVGENSPITREDVCSYLEFLGVKLDKQKNEETPPGKEGIISTPDSRVKVLVVPTNEELMIARDTKEIVEKIGR

SEQ ID NO: 451 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattagcggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 452 - protein, 412 aa, Artificial Sequence
  Engineered variant of acetate kinase from Thermotoga maritima
MGSHHHHHGSRVLVINSGSSSIKYQLIEMEGEKVLCKGIAERIGISGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 453 - DNA, 1236 bp, Artificial Sequence
  Engineered variant of acetate kinase from Thermotoga maritima
atgggtagccatcatcatcatcacggtagccgtgttctgagcattaatagcggtagcagcagcattaaatatcagctgattgaaatggaaggtgaaaaagttctgtgtaaaggtattgcagaacgtattggtattagcggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatagtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagagggcattcgtggtaaagaaggtattattagcaccccggatagccgtgttaaagttctggttgtgccgaccaatgaagaactgatgattgcacgtgataccaaagaaattgttgaaaaaatcggtcgt

SEQ ID NO: 454 - protein, 412 aa, Artificial Sequence
  Engineered variant of acetate kinase from Thermotoga maritima
MGSHHHHHGSRVLSINSGSSSIKYQLIEMEGEKVLCKGIAERIGISGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYSLSKGFSSDMRDIEEAALKGDEWCKLVLEIYDYRIAKYIGAYAAAMNGVDAIVFTAGVTENSPITREDVCSYLEFLGVKLDKQKNEEGIRGKEGIISTPDSRVKVLVVPTNEELMIARDTKEIVEKIGR

SEQ ID NO: 455 - DNA, 1236 bp, Artificial Sequence
  Engineered variant of acetate kinase from Thermotoga maritima
atgggtagccatcatcatcatcacggtagccgtgttctggtgattaatagcggtagcagcagcatcaaatatcagctgattgaaatggaaggtgaaaaagttctgtgtaaagctattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 456 - protein, 412 aa, Artificial Sequence
  Engineered variant of acetate kinase from Thermotoga maritima
MGSHHHHHGSRVLVINSGSSSIKYQLIEMEGEKVLCKAIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDVEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 457 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattcgccgtagccgtctggttcatcgtgttggtgatgaaaaacatgttattgaacgtgaactgccggatcatgaagaagcactgaaactgatcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatagtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagacgattcgtggtaaagaaggtattattagcaccccggatagccgtgttaaagttctgggtccgccgaccaatgaagaactgatgattgcacgtgataccaaagaaattgttgaaaaaatcggtcgt

SEQ ID NO: 458 - protein, 412 aa, Artificial Sequence
  Engineered variant of acetate kinase from Thermotoga maritima
MGSHHHHHGSRVLVINSGSSSIKYQLIEMEGEKVLCKGIAERIGIRRSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYSLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLGPPTNEELMIARDTKEIVEKIGR

SEQ ID NO: 459 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtttcgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaacggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattggcccgcaggaaatgtatgatattctgaataaaaaaagcggcgtttatggtctgagcaaaggtcgtagctcggatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccagcgctggtaaagaaggtattattagcaccccggatagccgtgttaaagttctggttgttccgaccaatgaagaactgatgattgcacgtgataccaaagaaattgttgaaaaaatcggtcgt

SEQ ID NO: 460 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGIGPQEMYDILNKKSGVYGLSKGRSSDMRDIEEAALKGDEWCKLVLEIYDYRIAKYIGAYAAAMNGVDAIVFTAGVGENSPITREDVCSYLEFLGVKLDKQKNEETSAGKEGIISTPDSRVKVLVVPTNEELMIARDTKEIVEKIGR

SEQ ID NO: 461 - DNA, 1236 bp, Artificial Sequence
  Engineered variant of acetate kinase from Thermotoga maritima
atgggtagccatcatcatcatcacggtagccgtgttctgaacattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 462 - protein, 412 aa, Artificial Sequence
  Engineered variant of acetate kinase from Thermotoga maritima
MGSHHHHHGSRVLNINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 463 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtttcgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtactagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtcgtagctcggatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccccagctggtaaagaaggtattattagcaccccggatagccgtgttaaagttctggttgttccgaccaatgaagaactgatgattgcacgtgataccaaagaaattgttgaaaaaatcggtcgt

SEQ ID NO: 464 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGRSSDMRDIEEAALKGDEWCKLVLEIYDYRIAKYIGAYAAAMNGVDAIVFTAGVGENSPITREDVCSYLEFLGVKLDKQKNEETPAGKEGIISTPDSRVKVLVVPTNEELMIARDTKEIVEKIGR

SEQ ID NO: 465 - DNA, 1236 bp, Artificial Sequence
  Engineered variant of acetate kinase from Thermotoga maritima
atgggtagccatcatcatcatcacggtagccgtgttctgagcattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgatcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggcgctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttccgccgaccaatgaagaactgatgattgcacgtgataccaaagaaattgttgaaaaaatcggtcgt

SEQ ID NO: 466 - protein, 412 aa, Artificial Sequence
  Engineered variant of acetate kinase from Thermotoga maritima
MGSHHHHHGSRVLSINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLALEIYDYRIAKYIGAYAAAMNGVDAIVFTAGVGENSPITREDVCSYLEFLGVKLDKQKNEETIRGKEGIISTPDSRVKVLVPPTNEELMIARDTKEIVEKIGR

SEQ ID NO: 467 - DNA, 1236 bp, Artificial Sequence
  Engineered variant of acetate kinase from Thermotoga maritima
atgggtagccatcatcatcatcacggtagccgtgttctgaacattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 468 - protein, 412 aa, Artificial Sequence
  Engineered variant of acetate kinase from Thermotoga maritima
MGSHHHHHGSRVLNINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 469 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 470 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDMRDVEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 471 - DNA, 1236 bp, Artificial Sequence
  Engineered variant of acetate kinase from Thermotoga maritima
atgggtagccatcatcatcatcacggtagccgtgttctggtgattaatagcggtagcagcagcatcaaatatcagctgattgaaatggaaggtgaaaaagttctgtgtaaaggtattgcagaacgtattggtattgaaggtagccgttttgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaaagcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 472 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 473 - DNA, 1236 bp, Artificial Sequence
  Engineered variant of acetate kinase from Thermotoga maritima
atgggtagccatcatcatcatcacggtagccgtgttctgaacattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 474 - protein, 412 aa, Artificial Sequence
  Engineered variant of acetate kinase from Thermotoga maritima
MGSHHHHHGSRVLNINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 475 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggtcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatagtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttccgccgaccaatgaagaactgatgattgcacgtgataccaaagaaattgttgaaaaaatcggtcgt

SEQ ID NO: 476 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYSLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVPPTNEELMIARDTKEIVEKIGR

SEQ ID NO: 477 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 478 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 479 - DNA, 1236 bp, Artificial Sequence
  Engineered variant of acetate kinase from Thermotoga maritima
atgggtagccatcatcatcatcacggtagccgtgttctggttattaatagcggtagcagcagcaataaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgccggtgttggtgaaaatagcccgattacccgtgaagatgtttgtagctatctggaatttctgggtgttaaactggataaacagaaaaatgaagagaccccagctggtaaagaaggtattattagcaccccggatagccgtgttaaagttctggttgttccgaccaatgaagaactgatgattgcacgtgataccaaagaaattgttgaaaaaatcggtcgt

SEQ ID NO: 480 - protein, 412 aa, Artificial Sequence
  Engineered variant of acetate kinase from Thermotoga maritima
MGSHHHHHGSRVLVINSGSSSNKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETPAGKEGIISTPDSRVKVLVVPTNEELMIARDTKEIVEKIGR

SEQ ID NO: 481 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgagggtagccgtctggttcatcgtgttggtgatgaaaaacatgttattgaacgtgaactgccggatcatgaagaagcactgaaactgatcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggcgctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagggcattcgtggtaaagaaggtattattagcaccccggatagccgtgttaaagttctggttccgccgaccaatgaagaactgatgattgcacgtgataccaaagaaattgttgaaaaaatcggtcgt

SEQ ID NO: 482 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLALEIYDYRIAKYIGAYAAAMNGVDAIVFTAGVGENSPITREDVCSYLEFLGVKLDKQKNEEGIRGKEGIISTPDSRVKVLVPPTNEELMIARDTKEIVEKIGR

SEQ ID NO: 483 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtttcgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcacaatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaacggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtgttagctcggatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgccggtgttggtgaaaatagcccgattacccgtgaagatgtttgtagctatctggaatttctgggtgttaaactggataaacagaaaaatgaagagaccccagctggtaaagaaggtattattagcaccccggatagccgtgttaaagttctggttgttccgaccaatgaagaactgatgattgcacgtgataccaaagaaattgttgaaaaaatcggtcgt

SEQ ID NO: 484 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGVSSDMRDIEEAALKGDEWCKLVLEIYDYRIAKYIGAYAAAMNGVDAIVFTAGVGENSPITREDVCSYLEFLGVKLDKQKNEETPAGKEGIISTPDSRVKVLVVPTNEELMIARDTKEIVEKIGR

SEQ ID NO: 485 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaagctattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 486 - protein, 412 aa, Artificial Sequence
  Engineered variant of acetate kinase from Thermotoga maritima
MGSHHHHHGSRVLVINSGSSSIKYQLIEMEGEKVLCKAIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDMRDVEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 487 - DNA, 1236 bp, Artificial Sequence
  Engineered variant of acetate kinase from Thermotoga maritima
atgggtagccatcatcatcatcacggtagccgtgttctggtgattaatagcggtagcagcagcatcaaatatcagctgattgaaatggaaggtgaaaaagttctgtgtaaaggtattgcagaacgtattggtattgaaggtagccgttttgttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 488 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDVEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 489 - DNA, 1236 bp, Artificial Sequence
  Engineered variant of acetate kinase from Thermotoga maritima
atgggtagccatcatcatcatcacggtagccgtgttctggttattaatagcggtagcagcagccataaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 490 - protein, 412 aa, Artificial Sequence
  Engineered variant of acetate kinase from Thermotoga maritima
MGSHHHHHGSRVLVINSGSSSHKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVCENSPITREDVCSYLEFLGVKLDKQKNEETIRGKEGIISTPDSRVKVLVVPTNEELMIARDTKEIVEKIGR

SEQ ID NO: 491 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattagcggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatagtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagaggacattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 492 - protein, 412 aa, Artificial Sequence
  Engineered variant of acetate kinase from Thermotoga maritima
MGSHHHHHGSRVLVINSGSSSIKYQLIEMEGEKVLCKGIAERIGISGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYSLSKGFSSDMRDIEEAALKGDEWCKLVLEIYDYRIAKYIGAYAAAMNGVDAIVFTAGVGENSPITREDVCSYLEFLGVKLDKQKNEEDIRGKEGIISTPDSRVKVLVVPTNEELMIARDTKEIVEKIGR

SEQ ID NO: 493 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggcattttcgaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcacaatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtactagccatcgttatgttagcaaacgtgcagcagaaattctgggtaaaaaactggaagaattgaaaattatcacctgtcatattggtaacggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtcgtagctcggatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgccggtgttggtgaaaatagcccgattacccgtgaagatgtttgtagctatctggaatttctgggtgttaaactggataaacagaaaaatgaagagaccccacctggtaaagaaggtattattagcaccccggatagccgtgttaaagttctggttgttccgaccaatgaagaactgatgattgcacgtgataccaaagaaattgttgaaaaaatcggtcgt

SEQ ID NO: 494 - protein, 412 aa, Artificial Sequence
  Engineered variant of acetate kinase from Thermotoga maritima
MGSHHHHHGSRVLVINSGSSSIKYQLIEMEGEKVLCKGIFERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGRSSDMRDIEEAALKGDEWCKLVLEIYDYRIAKYIGAYAAAMNGVDAIVFTAGVGENSPITREDVCSYLEFLGVKLDKQKNEETPPGKEGIISTPDSRVKVLVVPTNEELMIARDTKEIVEKIGR

SEQ ID NO: 495 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcacaatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtactagccatcgttatgttagcaaacgtgcagcagaaattctgggtaaaaaactggaagaattgaaaattatcacctgtcatattggtaacggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtgttagctcggatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgccggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 496 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGVSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 497 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgagggtagccgtctggttcatcgtgttggtgatgaaaaacatgttattgaacgtgaactgccggatcatgaagaagcactgaaactgatcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatagtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctgggtgtgccgaccaatgaagaactgatgattgcacgtgataccaaagaaattgttgaaaaaatcggtcgt

SEQ ID NO: 498 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYSLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLGVPTNEELMIARDTKEIVEKIGR

SEQ ID NO: 499 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtttcgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcacaatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgccggtgttggtgaaaatagcccgattacccgtgaagatgtttgtagctatctggaatttctgggtgttaaactggataaacagaaaaatgaagagaccccacgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 500 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETPRGKEGIISTPDSRVKVLVVPTNEELMIARDTKEIVEKIGR

SEQ ID NO: 501 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattcgcggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggtgctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagaggacattcgtggtaaagaaggtattattagcaccccggatagccgtgttaaagttctgggtccgccgaccaatgaagaactgatgattgcacgtgataccaaagaaattgttgaaaaaatcggtcgt

SEQ ID NO: 502 - protein, 412 aa, Artificial Sequence
  Engineered variant of acetate kinase from Thermotoga maritima
MGSHHHHHGSRVLVINSGSSSIKYQLIEMEGEKVLCKGIAERIGIRGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEEDIRGKEGIISTPDSRVKVLGPPTNEELMIARDTKEIVEKIGR

SEQ ID NO: 503 - DNA, 1236 bp, Artificial Sequence
  Engineered variant of acetate kinase from Thermotoga maritima
atgggtagccatcatcatcatcacggtagccgtgttctggtgattaatagcggtagcagcagccataaatatcagctgattgaaatggaaggtgaaaaagttctgtgtaaaggtattgcagaacgtattggtattgcaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 504 - protein, 412 aa, Artificial Sequence
  Engineered variant of acetate kinase from Thermotoga maritima
MGSHHHHHGSRVLVINSGSSSHKYQLIEMEGEKVLCKGIAERIGIAGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDVEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 505 - DNA, 1236 bp, Artificial Sequence
  Engineered variant of acetate kinase from Thermotoga maritima
atgggtagccatcatcatcatcacggtagccgtgttctgaacattaatagcggtagcagcagcattaaatatcagctgattgaaatggaaggtgaaaaagttctgtgtaaaggtattgcagaacgtattggtattagccgtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggtgctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagacgattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 506 - protein, 412 aa, Artificial Sequence
  Engineered variant of acetate kinase from Thermotoga maritima
MGSHHHHHGSRVLNINSGSSSIKYQLIEMEGEKVLCKGIAERIGISRSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 507 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaacggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccagccctggtaaagaaggtattattagcaccccggatagccgtgttaaagttctggttgttccgaccaatgaagaactgatgattgcacgtgataccaaagaaattgttgaaaaaatcggtcgt

SEQ ID NO: 508 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETSPGKEGIISTPDSRVKVLVVPTNEELMIARDTKEIVEKIGR

SEQ ID NO: 509 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaaagcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatattgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 510 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKSVDTSMGFTPTEGLVMGTRSGDLDPAIPFFIMEKEGISPQEMYDILNKKSGVLGLSKGFSSDMRDIEEAALKGDEWCKLVLEIYDYRIAKYIGAYAAAMNGVDAIVFTAGVCENSPITREDVCSYLEFLGVKLDKQKNEETIRGKEGIISTPDSRVKVLVVPTNEELMIARDTKEIVEKIGR

SEQ ID NO: 511 - DNA, 1236 bp, Artificial Sequence
  Engineered variant of acetate kinase from Thermotoga maritima
atgggtagccatcatcatcatcacggtagccgtgttctggttattaatagcggtagcagcagcatcaaatatcagctgattgaaatggaaggtgaaaaagttctgtgtaaaggtattgcagaacgtattggtattgcaggtagccgttttgttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgcgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 512 - protein, 412 aa, Artificial Sequence
  Engineered variant of acetate kinase from Thermotoga maritima
MGSHHHHHGSRVLVINSGSSSIKYQLIEMEGEKVLCKGIAERIGIAGSRFVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 513 - DNA, 1236 bp, Artificial Sequence
  Engineered variant of acetate kinase from Thermotoga maritima
atgggtagccatcatcatcatcacggtagccgtgttctgaacattaatagcggtagcagcagcattaaatatcagctgattgaaatggaaggtgaaaaagttctgtgtaaaggtattgcagaacgtattggtattgcaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 514 - protein, 412 aa, Artificial Sequence
  Engineered variant of acetate kinase from Thermotoga maritima
MGSHHHHHGSRVLNINSGSSSIKYQLIEMEGEKVLCKGIAERIGIAGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 515 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggcgctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttccgccgaccaatgaagaactgatgattgcacgtgataccaaagaaattgttgaaaaaatcggtcgt

SEQ ID NO: 516 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLALEIYDYRIAKYIGAYAAAMNGVDAIVFTAGVTENSPITREDVCSYLEFLGVKLDKQKNEETIRGKEGIISTPDSRVKVLVPPTNEELMIARDTKEIVEKIGR

SEQ ID NO: 517 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcacaatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtactagccatcgttatgttagcaaacgtgcagcagaaattctgggtaaaaaactggaagaattgaaaattatcacctgtcatattggtaacggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagctcggatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgccggtgttggtgaaaatagcccgattacccgtgaagatgtttgtagctatctggaatttctgggtgttaaactggataaacagaaaaatgaagagaccagcgctggtaaagaaggtattattagcaccccggatagccgtgttaaagttctggttgttccgaccaatgaagaactgatgattgcacgtgataccaaagaaattgttgaaaaaatcggtcgt

SEQ ID NO: 518 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETSAGKEGIISTPDSRVKVLVVPTNEELMIARDTKEIVEKIGR

SEQ ID NO: 519 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaagctattgcagaacgtattggtattgcaggtagccgttttgttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattgatggtaaagaaggtattattagcaccccggatagccgtgttaaagttctggttgttccgaccaatgaagaactgatgattgcacgtgataccaaagaaattgttgaaaaaatcggtcgt

SEQ ID NO: 520 - protein, 412 aa, Artificial Sequence
  Engineered variant of acetate kinase from Thermotoga maritima
MGSHHHHHGSRVLVINSGSSSIKYQLIEMEGEKVLCKAIAERIGIAGSRFVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIDGKEGIISTPDSRVKVLVVPTNEELMIARDTKEIVEKIGR

SEQ ID NO: 521 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatagtggggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 522 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDSGEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 523 - DNA, 1236 bp, Artificial Sequence; identical to SEQ ID NO: 377
  Engineered variant of acetate kinase from Thermotoga maritima

SEQ ID NO: 524 - protein, 412 aa, Artificial Sequence; identical to SEQ ID NO: 378
  Engineered variant of acetate kinase from Thermotoga maritima

SEQ ID NO: 525 - DNA, 1236 bp, Artificial Sequence
  Engineered variant of acetate kinase from Thermotoga maritima
atgggtagccatcatcatcatcacggtagccgtgttctgaacattaatagcggtagcagcagcattaaatatcagctgattgaaatggaaggtgaaaaagttctgtgtaaagctattgcagaacgtattggtattgaaggtagccgttttgttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatagtgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggcgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 526 - protein, 412 aa, Artificial Sequence
  Engineered variant of acetate kinase from Thermotoga maritima
MGSHHHHHGSRVLNINSGSSSIKYQLIEMEGEKVLCKAIAERIGIEGSRFVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDSEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 527 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 528 - protein, 412 aa, Artificial Sequence; identical to SEQ ID NO: 470
  Engineered variant of acetate kinase from Thermotoga maritima

SEQ ID NO: 529 - DNA, 1236 bp, Artificial Sequence
  Engineered variant of acetate kinase from Thermotoga maritima
atgggtagccatcatcatcatcacggtagccgtgttctgaacattaatagcggtagcagcagcattaaatatcagctgattgaaatggaaggtgaaaaagttctgtgtaaaggtattgcagaacgtattggtattgagggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagagacgattcgtggtaaagaaggtattattagcaccccggatagccgtgttaaagttctggttccgccgaccaatgaagaactgatgattgcacgtgataccaaagaaattgttgaaaaaatcggtcgt

SEQ ID NO: 530 - protein, 412 aa, Artificial Sequence
  Engineered variant of acetate kinase from Thermotoga maritima
MGSHHHHHGSRVLNINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVTENSPITREDVCSYLEFLGVKLDKQKNEETIRGKEGIISTPDSRVKVLVPPTNEELMIARDTKEIVEKIGR

SEQ ID NO: 531 - DNA, 1236 bp, Artificial Sequence
  Engineered variant of acetate kinase from Thermotoga maritima
atgggtagccatcatcatcatcacggtagccgtgttctggtgattaatagcggtagcagcagcatcaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatgtggaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 532 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDVEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 533 - DNA, 1236 bp, Artificial Sequence
  Engineered variant of acetate kinase from Thermotoga maritima
atgggtagccatcatcatcatcacggtagccgtgttctggttattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttccgccgaccaatgaagaactgatgattgcacgtgataccaaagaaattgttgaaaaaatcggtcgt

SEQ ID NO: 534 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDIEEAALKGDEWCKLVLEIYDYRIAKYIGAYAAAMNGVDAIVFTAGVTENSPITREDVCSYLEFLGVKLDKQKNEETIRGKEGIISTPDSRVKVLVPPTNEELMIARDTKEIVEKIGR

SEQ ID NO: 535 - DNA, 1236 bp, Artificial Sequence
  Engineered variant of acetate kinase from Thermotoga maritima
atgggtagccatcatcatcatcacggtagccgtgttctggtgattaatagcggtagcagcagcatcaaatatcagctgattgaaatggaaggtgaaaaagttctgtgtaaaggtattgcagaacgtattggtattgaaggtagccgttttgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatgctggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatactgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgtttgcgaaaatagcccgattacccgtgaagatgtttgtagctatctggaatttctgggtgttaaactggataaacagaaaaatgaagagaccattcgcggtaaagaaggtattattagcaccccggatagccgtgttaaagttctggttgttccgaccaatgaagaactgatgattgcacgtgataccaaagaaattgttgaaaaaatcggtcgt

SEQ ID NO: 536 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHAGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDTEEAALKGDEWCKLVLEIYDYRIAKYIGAYAAAMNGVDAIVFTAGVCENSPITREDVCSYLEFLGVKLDKQKNEETIRGKEGIISTPDSRVKVLVVPTNEELMIARDTKEIVEKIGR

SEQ ID NO: 537 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggtcctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggtgctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctgggtccgccgaccaatgaagaactgatgattgcacgtgataccaaagaaattgttgaaaaaatcggtcgt

SEQ ID NO: 538 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLGPPTNEELMIARDTKEIVEKIGR

SEQ ID NO: 539 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcacaatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtactagccatcgttatgttagcaaacgtgcagcagaaattctgggtaaaaaactggaagaattgaaaattatcacctgtcatattggtaacggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagctcggatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgccggtgttggtgaaaatagcccgattacccgtgaagatgtttgtagctatctggaatttctgggtgttaaactggataaacagaaaaatgaagagaccccacgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 540 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETPRGKEGIISTPDSRVKVLVVPTNEELMIARDTKEIVEKIGR

SEQ ID NO: 541 - DNA, 1236 bp, Artificial Sequence
  Engineered variant of acetate kinase from Thermotoga maritima
atgggtagccatcatcatcatcacggtagccgtgttctggtaattaatagcggtagcagcagcattaaatatcagctgattgaaatggaaggtgaaaaagttctgtgtaaaggtattgcagaacgtattggtattgaaggtagccgttttgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatctgcgtgatattgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 542 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDLRDIEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 543 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaacggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggtcgtagctcggatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccagccgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 544 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGRSSDMRDIEEAALKGDEWCKLVLEIYDYRIAKYIGAYAAAMNGVDAIVFTAGVGENSPITREDVCSYLEFLGVKLDKQKNEETSRGKEGIISTPDSRVKVLVVPTNEELMIARDTKEIVEKIGR

SEQ ID NO: 545 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgagggtagccgtctggttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggtgctggaaatttatgattaccgtattgcaaaatacatcggtgcatacgctgcagcaatgaatggtgttgatgcaattgtttttaccgcaggtgttaccgaaaatagcccgattacccgtgaagatgtttgtagctatctggaatttctgggtgttaaactggataaacagaaaaatgaagagacgattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 546 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVTENSPITREDVCSYLEFLGVKLDKQKNEETIRGKEGIISTPDSRVKVLVVPTNEELMIARDTKEIVEKIGR

SEQ ID NO: 547 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtctggttcatcgtgttggtgatgaaaaacatgttattgaacgtgaactgccggatcatgaagaagcactgaaactggttctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcataatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgttctgggtctgagcaaaggttttagcagcgatatgcgtgatagtgaggaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccattcgtggtaaagaaggtattattagcaccccggatagccgtgttaaagttctggttgttccgaccaatgaagaactgatgattgcacgtgataccaaagaaattgttgaaaaaatcggtcgt

SEQ ID NO: 548 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRLVHRVGDEKHVIERELPDHEEALKLVLNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVLGLSKGFSSDMRDSEEAALKGDEWCKLVLEIYDYRIAKYIGAYAAAMNGVDAIVFTAGVGENSPITREDVCSYLEFLGVKLDKQKNEETIRGKEGIISTPDSRVKVLVVPTNEELMIARDTKEIVEKIGR

SEQ ID NO: 549 - DNA, 1236 bp, Artificial Sequence
  Engineered variant of acetate kinase from Thermotoga maritima
atgggtagccatcatcatcatcacggtagccgtgttctggtgattaatagcggtagcagcagcattaaatatcagctgattgaaatggaaggtgaaaaagttctgtgtaaaggtattgcagaacgtattggtattgaaggtagccgtttcgttcatcgtgttggtgatgaaaaacatgttattgaacgtgaactgccggatcatgaagaagcactgaaactgattctgaataccctggttgatgaaaaactgggtgttattaaagatctgaaagaaattgacgcagttggtcatcgtgttgttcatggtggtgaacgttttaaagaaagcgttctggttgatgaagaagttctgaaagcaattgaagaagttagcccgctggcaccgctgcacaatccggcaaatctgatgggtattaaagtagcaatgaaactgctgccgggtgttccgaatgttgcagtttttgataccgcatttcatcagaccattccgcagaaagcatatctgtatgcaattccgtatgaatattacgaaaaatacaaaattcgtcgctacggttttcatggtaccagccatcgttatgttagcaaacgtgcagcagaaattctgggtaaaaaactggaagaattgaaaattatcacctgtcatattggtaatggtgcaagcgttgcagcagttaaatatggtaaatgtgttgataccagcatgggttttaccccgactgaaggtctggttatgggtacccgtagcggtgatctggatccggcaattccgttttttattatggaaaaagagggtattagcccgcaggaaatgtatgatattctgaataaaaaaagcggcgtttatggtctgagcaaaggttttagcagcgatatgcgtgatattgaagaagcagcactgaaaggtgatgaatggtgtaaactggttctggaaatttatgattaccgtattgcaaaatacatcggtgcatacgctgcagcaatgaatggtgttgatgcaattgtttttaccgcaggtgttggtgaaaatagcccgattacccgtgaagatgtttgtagctatctggaatttctgggtgttaaactggataaacagaaaaatgaagagaccagcgctggtaaagaaggtattattagcaccccggatagccgtgttaaagttctggttgttccgaccaatgaagaactgatgattgcacgtgataccaaagaaattgttgaaaaaatcggtcgt

SEQ ID NO: 550 - protein, 412 aa, Artificial Sequence
  Engineered variant of acetate kinase from Thermotoga maritima
MGSHHHHHGSRVLVINSGSSSIKYQLIEMEGEKVLCKGIAERIGIEGSRFVHRVGDEKHVIERELPDHEEALKLILNTLVDEKLGVIKDLKEIDAVGHRVVHGGERFKESVLVDEEVLKAIEEVSPLAPLHNPANLMGIKVAMKLLPGVPNVAVFDTAFHQTIPQKAYLYAIPYEYYEKYKIRRYGFHGTSHRYVSKRAAEILGKKLEELKIITCHIGNGASVAAVKYGKCVDTSMGFTPTEGLVMGTRSGDLDPAIPFFIMEKEGISPQEMYDILNKKSGVYGLSKGFSSDMRDIEEAALKGDEWCKLVLEIYDYRIAKYIGAYAAAMNGVDAIVFTAGVGENSPITREDVCSYLEFLGVKLDKQKNEETSAGKEGIISTPDSRVKVLVVPTNEELMIARDTKEIVEKIGR

SEQ ID NO: 551 - protein, 229 aa, Artificial Sequence
  Engineered variant of Guanylate kinase from Brachistoma floridae
MHHHHHHALPTPVVICGPSGSGKTTLYNKLLKEFPGVFQLSVSHTTRQPRPGEENGREFHFINRDQFQENIKQGDFLEWAEHSGNLYGTSKKALEEVQANNVIPILDIDTQGVRTVKKASLEAVYIFIKPPSIDVLEERLRSRGTETEEALQKRLSAAPNELEYGLKPGNFQHIITNDDLDVAYEKLKGILIDSQMPLAGATGSSSSVVNSFLDKPAASATTVNSSSQD

SEQ ID NO: 552 - protein, 229 aa, Artificial Sequence
  Engineered variant of Guanylate kinase from Brachistoma floridae
MHHHHHHALPTPVVICGPSGSGKTTLYNKLLKEFPGVFQLTASHTTRQPRPGEENGREFHFINRDQFQENIKQGDFLEWAEHSGNLYGTSKKALEEVQANNVIPILDIDTQGVRTVKKASLEAVYIFIKPPSIEVLEERLRSRGTETEEALQKRLSAAPNELEYGLKPGNFQHIITNDDLDVAYEKLKGILIDSQMPLAGATGSSSSVVNSFLDKPAASATTVNSSSQD

SEQ ID NO: 553 - protein, 228 aa, Artificial Sequence
  Engineered Variant  of Adenylate kinase from Saccharomyces cerevisiae
MHHHHHHSSSESIRMVLIGPPGAGKGTQAPNLQERFHACHLATGDMLRSQIAKGTQLGLEAKKIMDQGGLVSDDIMVNMIKDELTNNPACKNGFILDGFPRTIPQAEKLDQMLKEQGTPLEKAVELKIDDELLPARITGRLIHPASGRSYHKIFNPPKEDMKDDVTGEALVQRSDDNADALKKRLAAYHKQTEPVVDFYKKTGIWAGVDASQPPATVWADILNKLGKD

SEQ ID NO: 554 - protein, 228 aa, Artificial Sequence
  Engineered Variant  of Adenylate kinase from Saccharomyces cerevisiae
MHHHHHHSSSESIRMVLIGPPGAGKGTQAPNLQERFHACHLGTGDMLRSQIAKGTQLGLEAKKIMDQGGLVSDDIMVNMIKDELTNNPACKNGFILDGFPRTIPQAEKLDQMLKEQGTPLEKAVELKIDDELLPARITGRLIHPASGRSYHKIFNPPKEDMKDDVTGEALVQRSDDNADALKKRLAAYHKQTEPVVDFYKKTGIWAGVDASQPPATVWADILNKLGKD

We claim:

1. An engineered acetate kinase comprising a polypeptide sequence having at least 90%, 91%, 92%, 93%, 94%, 95%, 96%, 97%, 98%, or 99% sequence identity to SEQ ID NOs: 2 and/or 4, or a functional fragment thereof, wherein the polypeptide sequence of said engineered acetate kinase comprises at least one substitution at position 294, or substitution set comprising a substitution at position 294 and wherein the amino acid positions of said polypeptide sequence are numbered with reference to SEQ ID NOs: 2 and/or 4.

2. The engineered acetate kinase of claim 1, wherein said polypeptide sequence has at least 90%, 91%, 92%, 93%, 94%, 95%, 96%, 97%, 98%, or 99% sequence identity to SEQ ID NO: 2, and wherein the polypeptide sequence of said engineered acetate kinase further comprises at least one substitution or substitution set at one or more positions in said polypeptide sequence selected from 4/142/242, 12/76/164/284, 12/76/232, 15, 23, 39, 41, 47, 51, 52, 54, 57, 76, 76/164/232/262/386, 76/164/262/284, 76/232/262/284/386, 76/232/364/386, 76/262, 76/262/273, 76/262/364, 76/273, 76/284/299, 76/364, 130, 135/284, 135/392, 145/400, 191, 232, 232/386, 275, 285, 288, 290, 292, 297, 298, 298/377, 298/405, 343, 372, 373, 374, 376, 391, and 392, wherein the amino acid positions of said polypeptide sequence are numbered with reference to SEQ ID NO: 2.

3. The engineered acetate kinase of claim 1, wherein said polypeptide sequence of said engineered acetate kinase has at least 90%, 91%, 92%, 93%, 94%, 95%, 96%, 97%, 98%, or 99% sequence identity to SEQ ID NO: 2, and wherein said polypeptide sequence of said engineered acetate kinase further comprises at least one substitution or substitution set at one or more positions selected from 4/142/242, 12/76/164, 15, 23, 39, 41, 44, 45, 47, 47/411, 48, 50, 51, 53, 55, 57/135, 58, 58/135, 61, 76, 76/142/299/386, 76/164, 76/164/232/262/386, 76/164/262, 76/164/273, 76/164/287/364, 76/164/386, 76/232, 76/232/259/364, 76/232/262, 76/232/273/299/311/386, 76/232/364/386, 76/262, 76/262/273, 76/262/284/287/386, 76/262/284/364, 76/262/287, 76/262/364, 76/273, 76/284/299, 76/284/311/386, 76/364, 76/386, 130, 132, 135/284, 135/392, 145/400, 164/232/284/287, 191, 220, 220/360, 241, 246, 262/284/287, 273/311/313/364, 275, 279, 283, 285, 287, 288, 289, 290, 292, 297, 298, 298/405, 299, 311, 311/364/386, 332, 340, 343, 343/388, 347, 364, 372, 373, 374, 375, 376, 391, 392, and 405, wherein the amino acid positions of said polypeptide sequence are numbered with reference to SEQ ID NO: 2.

4. The engineered acetate kinase of claim 1, wherein said polypeptide sequence of said engineered acetate kinase has at least 90%, 91%, 92%, 93%, 94%, 95%, 96%, 97%, 98%, or 99% sequence identity to SEQ ID NO: 4, and wherein said polypeptide sequence of said engineered acetate kinase further comprises at least one substitution or substitution set at one or more positions selected from 14, 14/46, 14/46/47, 14/46/75/293/296/342, 14/46/284/342/371, 14/46/293, 14/50/231/283/296, 14/75,14/284/371, 14/310/391, 14/373, 22/46/296/373, 22/75/342, 22/231/283/373, 22/283/293/296, 22/296, 22/296/373, 22/372/373, 38/283/296/373, 38/296/373, 40/289/372/373, 46, 46/47/284/293, 46/47/284/390/391, 46/47/284/391, 46/50/54/342/373, 46/50/75/373, 46/50/283/296/297/373, 46/50/293/296, 46/50/293/297, 46/284/371, 46/293, 46/371/390/391, 47/75/284/293/371, 47/284/371/391, 47/293/310/371, 47/342/391, 50/75/283/293/296, 50/75/296, 50/75/373, 50/231/283/342, 50/231/373, 50/268/289/372/373, 50/283/293/296, 50/283/293/342/373, 50/289/372/373, 50/293/296, 50/372, 75/284/391, 75/293/296/373, 75/293/342, 75/293/391, 75/342/371, 231/283/342, 231/293/296/373, 231/296/342, 231/342/373, 283/293/296, 283/293/296/342, 283/296, 283/296/297/342, 283/296/342/373, 283/296/373, 283/356, 284/293/310/342/371, 284/293/390, 284/293/390/391, 284/342/371, 284/342/390, 284/390, 289, 289/372/373, 293, 293/296, 293/296/297, 293/296/342/373, 293/296/373, 293/342/373, 293/371, 293/390, 296/297, 296/342, 310/342/391, 310/371/391, 342, 342/371/391, 371, 371/390, 372/373, 373, and 390/391, wherein the amino acid positions of said polypeptide sequence are numbered with reference to SEQ ID NO: 4.

5. The engineered acetate kinase of claim 1, wherein said polypeptide sequence of said engineered acetate kinase has at least 90%, 91%, 92%, 93%, 94%, 95%, 96%, 97%, 98%, or 99% sequence identity to SEQ ID NO: 4, and wherein said polypeptide sequence of said engineered acetate kinase further comprises at least one substitution or substitution set at one or more positions selected from 14/38/50/75/293/296, 14/342/391, 38/46/50/75/373, 46/293, 47/342/391, 50/75/283/293/296, 50/75/296, 50/103/296/342, 50/231/373, 50/268/289/372/373, 50/283/293/296, 50/283/293/342/373, 50/293, 50/293/296, 50/372/373, 75/283/296, 75/293/296/297, 75/293/391, 75/342/371, 75/390/391, 283/296, 289, 289/372, 289/372/373, 293/342/373, 293/342/391, 293/371, 296, 296/342, 310/342/391, 342, 372, and 372/373, wherein the amino acid positions of said polypeptide sequence are numbered with reference to SEQ ID NO: 4.

6. The engineered acetate kinase of claim 1, wherein said engineered acetate kinase comprises a polypeptide sequence that is at least 90%, 91%, 92%, 93%, 94%, 95%, 96%, 97%, 98%, or 99% identical to the sequence of at least one engineered acetate kinase variant set forth in Table 2-1, 3-1, 4-1, and/or 5-1.

7. The engineered acetate kinase of claim 1, wherein said engineered acetate kinase comprises a polypeptide sequence that is at least 90%, 91%, 92%, 93%, 94%, 95%, 96%, 97%, 98%, or 99% identical to the sequence of at least one engineered acetate kinase variant set forth in the even numbered sequences of SEQ ID NOs: 6-550.

8. The engineered acetate kinase of claim 1, wherein said engineered acetate kinase comprises a polypeptide sequence set forth in at least one of the even numbered sequences of SEQ ID NOs: 6-550.

9. The engineered acetate kinase of claim 1, wherein said engineered acetate kinase comprises at least one improved property compared to wild-type *Thermotoga maritima* acetate kinase.

10. The engineered acetate kinase of claim 9, wherein said improved property comprises improved activity on a substrate.

11. The engineered acetate kinase of claim 10, wherein said substrate comprises Sp-3' Fluoro-3'-deoxyguanosine-5'-(1-thio)-diphosphate (F-thioGDP) and/or Sp-2' F-ara-adenosine-5'-(1-thio)-diphosphate (F-thioADP).

12. The engineered acetate kinase of claim 9, wherein said improved property comprises improved production of Sp-3'Fluoro-3'-deoxyguanosine-5'-(1-thio)-triphosphate (F-thioGTP) and/or Sp-2'Fluoro-ara-adenosine-5'-(1-thio)-triphosphate (F-thioATP).

13. The engineered acetate kinase of claim 1, wherein said engineered acetate kinase is purified.

14. A composition comprising at least one engineered acetate kinase of claim 1.

15. The engineered acetate kinase of claim 1, wherein the polypeptide sequence of said engineered acetate kinase comprises a substitution of X294L and wherein the amino acid positions of said polypeptide sequence are numbered with reference to SEQ ID NOs: 2 and/or 4.

16. The engineered acetate kinase of claim 1, wherein the polypeptide sequence of said engineered acetate kinase comprises a substitution of M294L and wherein the amino acid positions of said polypeptide sequence are numbered with reference to SEQ ID NOs: 2 and/or 4.

17. The engineered acetate kinase of claim 1, wherein the polypeptide sequence of said engineered acetate kinase comprises a polypeptide sequence set forth in SEQ ID NOs: 6, 202, 326, 328, 330, 332, 334, 336, 338, 340, 342, 344, 346, 348, 350, 352, 354, 356, 358, 360, 362, 364, 366, 368, 374, 382, 388, 390, 392, 396, 438, 440, 446, 448, 522, 526, 534, and 542.

* * * * *